US012116583B2

(12) United States Patent
Ambavaram et al.

(10) Patent No.: US 12,116,583 B2
(45) Date of Patent: Oct. 15, 2024

(54) MODIFIED PLANTS COMPRISING A POLYNUCLEOTIDE COMPRISING A NON-COGNATE PROMOTER OPERABLY LINKED TO A CODING SEQUENCE THAT ENCODES A TRANSCRIPTION FACTOR

(71) Applicant: Yield10 Bioscience, Inc., Woburn, MA (US)

(72) Inventors: Madana M. R. Ambavaram, Andover, MA (US); Venkatesh Bollina, Saskatoon (CA); Frank Anthony Skraly, Watertown, MA (US); Meghna Malik, Saskatoon (CA); Kristi D. Snell, Belmont, MA (US)

( * ) Notice: Subject to any disclaimer, the term of this patent is extended or adjusted under 35 U.S.C. 154(b) by 0 days.

(21) Appl. No.: 17/594,475

(22) PCT Filed: May 13, 2020

(86) PCT No.: PCT/US2020/032696
§ 371 (c)(1),
(2) Date: Oct. 18, 2021

(87) PCT Pub. No.: WO2020/232138
PCT Pub. Date: Nov. 19, 2020

(65) Prior Publication Data
US 2022/0235364 A1    Jul. 28, 2022

Related U.S. Application Data

(60) Provisional application No. 62/873,018, filed on Jul. 11, 2019, provisional application No. 62/847,658, filed on May 14, 2019.

(51) Int. Cl.
*C12N 15/82* (2006.01)
*C07K 14/415* (2006.01)

(52) U.S. Cl.
CPC ........ *C12N 15/8234* (2013.01); *C07K 14/415* (2013.01); *C12N 15/8247* (2013.01); *C12N 15/8267* (2013.01)

(58) Field of Classification Search
None
See application file for complete search history.

(56) References Cited

U.S. PATENT DOCUMENTS

| 2006/0150283 A1 | 7/2006 | Alexandrov et al. | |
| 2015/0259698 A1 | 9/2015 | Hatzfeld et al. | |
| 2018/0237793 A1* | 8/2018 | Aasen | C12N 15/8251 |
| 2019/0017067 A1* | 1/2019 | Hummel | C12N 9/1092 |
| 2019/0292554 A1* | 9/2019 | Scheller | C12N 15/52 |

FOREIGN PATENT DOCUMENTS

| CN | 104877021 A | 9/2015 |
| WO | 2007063289 A2 | 6/2007 |

OTHER PUBLICATIONS

Li et al., PEI1, an embryo-specific zinc finger protein gene required for heart-stage embryo formation in *Arabidopsis*, 1998, The Plant Cell 10: 383-398 (Year: 1998).*
Giles et al, Inferring Function from Homology, 2017, Bioinformatics: vol. II: Structure, Function, and Applications: 23-38. (Year: 2017).*
Malik et al, *Camelina sativa*, an oilseed at the nexus between model system and commercial crop, 2018, Plant Cell Reports 37: 1367-1381 (Year: 2018).*
Skraly et al, Metabolic engineering to increase crop yield: From concept to execution, 2018, Plant Science, 273: 23-32 (Year: 2018).*
Krishna et al, Structural classification of zinc fingers, 2003, Nucleic Acids Research, vol. 31: 532-550 (Year: 2003).*
Chai et al, Comprehensive analysis of CCCH zinc finger family in poplar (*Populus trichocarpa*) 2012, BMC Genomics 12:253 (Year: 2012).*
Deng et al, A CCCH-Type Zinc Finger Nucleic Acid-Binding Protein Quantitatively Confers Resistance against Rice Bacterial Blight Disease, 2012, Plant Physiology 158: 876-889 (Year: 2012).*
Wang et al, Transcriptome Association Identifies Regulators of Wheat Spike Architecture, 2017, Plant Physiology 175: 746-757 (Year: 2017).*
Guo H et al, Protein tolerance to random amino acid change, 2004, Proceedings of the National Academies of Science, 101:9205-9210. (Year: 2004).*
Rabara et al, The Potential of Transcription Factor-Based Genetic Engineering in Improving Crop Tolerance to Drought, 2014, OMICS A Journal of Integrative Biology 18: 601-614 (Year: 2014).*
UniProt Accession accession Q6V5F9_9BRAS, integrated Jul. 5, 2004, https://www.uniprot.org/uniprotkb/Q6V5F9/entry (Year: 2004 ).*
An et al, Overexpression of *Arabidopsis* WRI1 enhanced seed mass and storage oil content in *Camelina sativa*, 2015, Plant Biotechnology Reports 9: 137-148 (Year: 2015).*

(Continued)

*Primary Examiner* — Anne Kubelik
*Assistant Examiner* — Aleksandar Radosavljevic
(74) *Attorney, Agent, or Firm* — Pearne & Gordon LLP

(57) ABSTRACT

A modified plant is provided. The modified plant includes a polynucleotide including a promoter operably linked to a coding sequence. The coding sequence encodes a transcription factor that has at least 30% sequence identity to one or more of SEQ ID NOs: 27, 204, 10, 19, 1-9, 11-18, 20-26, 28-203, 205, 237, or 242-310. The promoter is non-cognate with respect to the coding sequence. Also provided is a method for producing a modified plant having increased seed yield and/or oil content in comparison to a reference plant by transformation. Also provided is a method for producing a modified plant having increased seed yield and/or oil content in comparison to a reference plant by editing.

15 Claims, 7 Drawing Sheets

Specification includes a Sequence Listing.

(56) References Cited

OTHER PUBLICATIONS

Bogamuwa, et al., "The *Arabidopsis* tandem CCCH zinc finger proteins AtTZF4, 5, and 6 are involved in light-, abscisic acid- and gibberellic acid-mediated regulation of seed germination," Plant, Cell & Environment, vol. 36, pp. 1507-1519 (2013).
Malik, et al., "*Camelina sativa*, an oilseed at the nexus between model system and commercial crop," Plant Cell Reports, vol. 37, pp. 1367-1381 (2018).
AYJ64356 amino acid sequence, from WO2010039750A2, Nov. 25, 2010, p. 1.
Ambavaram et al., "Coordinated regulation of photosynthesis in rice increases yield and tolerance to environmental stress," Nature Communications, DOI: 10.1038/ncomms6302; pp. 1-14, Published: Oct. 31, 2014.
Belhaj et al., "Plant genome editing made easy: targeted mutagenesis in model and crop plants using the CRISPR/Cas system," Plant Methods (2013); 9:39, pp. 1-10.
Demirer et al., "High aspect ratio nanomaterials enable delivery of functional genetic material without DNA integration in mature plants," Nature Nanotechnology, vol. 14, pp. 456-464 and supplemental pp. 1-3, May 2019, www.nature.com/naturenanotechnology.
Ding et al., "Recent Advances in Genome Editing Using CRISPR/Cas9," Frontiers in Plant Science, www.frontiersin.org; vol. 7, Article 703, pp. 1-12, Published: May 26, 2016.
Fu et al., "Coexpression Analysis Identifies Rice Starch Regulator1, a Rice AP2/EREBP Family Transcription Factor, as a Novel Rice Starch Biosynthesis Regulator," Plant Physiology, www.plantphysiol.org, vol. 154, pp. 927-938, Oct. 2010.
González-Morales et al., "Regulatory network analysis reveals novel regulators of seed desiccation tolerance in *Arabidopsis thaliana*," Proceedings of the National Academy of Sciences USA, pp. E5232-E5241, Published: Aug. 17, 2016, www.pnas.org/cgi/doi/10.1073/pnas.1610985113.
Jiang et al., "Demonstration of CRISPR/Cas9/sgRNA-mediated targeted gene modification in *Arabidopsis*, tobacco, sorghum and rice," Nucleic Acids Research, vol. 41, No. 20, e188, doi:10.1093/nar/gkt780, Published: Sep. 2, 2013, pp. 1-12.
Khandagale et al., "Genome editing for targeted improvement of plants," Plant Biotechnol. Rep., (Nov. 2016), vol. 10, pp. 327-343.
Konermann et al., "Genome-scale transcriptional activation by an engineered CRISPR-Cas9 complex," Nature, vol. 517, pp. 583-588 and supplemental pp. 1-12, Jan. 29, 2015, doi:10.1038/nature14136.
Kwak et al., "Chloroplast-selective gene delivery and expression in planta using chitosan-complexed single-walled carbon nanotube carriers," Nature Nanotechnology, vol. 14, pp. 447-455 and supplemental pp. 1-2, May 2019, www.nature.com/naturenanotechnology.
Li et al., "PEI1, an Embryo-Specific Zinc Finger Protein Gene Required for Heart-Stage Embryo Formation in *Arabidopsis*," The Plant Cell, vol. 10, pp. 383-398, Mar. 1998.
Li et al., "Multiplex and homologous recombination-mediated genome editing in *Arabidopsis* and *Nicotiana benthamiana* using guide RNA and Cas9," Nature Biotechnology, vol. 31, No. 8, pp. 688-691, Aug. 2013.
Lin et al., "Maize and millet transcription factors annotated using comparative genomic and transcriptomic data," BMC Genomics, vol. 15. No. 818, pp. 1-19, 2014, http://www.biomedcentral.com/1471-2164/15/818.
Liu et al., "CRISPR-P 2.0: An Improved CRISPR-Cas9 Tool for Genome Editing in Plants," Molecular Plant, Cell Press, Letter to the Editor, vol. 10, pp. 530-532, Mar. 2017.
Ma et al., "Wrinkled1, A Ubiquitous Regulator in Oil Accumulating Tissues from *Arabidopsis* Embryos to Oil Palm Mesocarp," PLOS One, vol. 8, Issue. 7, pp. 1-13, Jul. 2013, www.plosone.org.
Mali et al., "RNA-Guided Human Genome Engineering via Cas9," PMC, Aug. 15, 2013, pp. 1-8 (published in final edited form in Science, vol. 339, No. 6121, pp. 823-826).
Malik, et al., "Production of high levels of poly-3-hydroxybutyrate in plastids of *Camelina sativa* seeds," Plant Biotechnology Journal, vol. 13, pp. 675-688 (2015).
Matsuoka et al., "A single domestication for maize shown by multilocus microsatellite genotyping," Proceedings of the National Academy of Sciences USA, vol. 99, No. 9, pp. 6080-6084, Apr. 30, 2002, www.pnas.org/cgi/doi/10.1073/pnas.052125199.
Matz et al., "Fluorescent proteins from nonbioluminescent *Anthozoa* species," Nature Biotechnology, vol. 17, pp. 969-973, Oct. 1999, http://biotech.nature.com.
McDougall, "The cost and time involved in the discovery, development and authorisation of a new plant biotechnology derived trait," Crop Life International, Sep. 2011, pp. 1-24, available at https://croplife.org/wp-content/uploads/pdf_files/Getting-a-Biotech-Crop-to-Market-Phillips-McDougall-Study.pdf, last accessed Apr. 29, 2020.
Naito et al., "CRISPRdirect: software for designing CRISPR/Cas guide RNA with reduced off-target sites," Bioinformatics, vol. 31, No. 7, doi: 10.1093/bioinformatics/btu743, pp. 1120-1123, Nov. 20, 2014.
Pertea et al., "Transcript-level expression analysis of RNA-seq experiments with HISAT, StringTie and Ballgown," Nature Protocols, vol. 11, No. 9, pp. 1650-1667, (2016).
Simmonds, "10 Genetic Transformation of Soybean with Biolistics," in Genetic Transformation of Plants (eds. J.F. Jackson & H.F. Linskens), vol. 23, in Molecular Method of Plant Analysis (eds. .F. Jackson et al.), pp. I-XV and 159-174 (2003).
Skraly et al., "Metabolic engineering to increase crop yield: From concept to execution," Plant Sci., vol. 27, pp. 23-32 and supplemental pp. 1-3, doi: 10.1016/j.plantsci.2018.03.011 (Mar. 14, 2018).
Tan et al., "Enhanced Seed Oil Production in Canola by Conditional Expression of Brassica napus Leafy Cotyledon1 and LEC1-LIKE in Developing Seeds," Plant Physiology, vol. 156, pp. 1577-1588 (Jul. 2011), www.plantphysiol.org.
Wang, et al., "Transcriptome Association Identifies Regulators of Wheat Spike Architecture," Plant Physiology, vol. 175, pp. 746-757 (Oct. 2017), www.plantphysiol.org.
Wolfe et al., "Systematic survey reveals general applicability of "guilt-by-association" within gene coexpression networks," BMC Bioinformatics, vol. 6, No. 227, pp. 1-10 (Sep. 2005), http://www.biomedcentral.com/1471-2105/6/227.
Woo et al., "DNA-free genome editing in plants with preassembled CRISPR-Cas9 ribonucleoproteins," Nature Biotechnology, vol. 33, No. 11, pp. 1162-1165, Nov. 2015.
Zhang et al., "A general framework for weighted gene co-expression network analysis," Stat Appl Genet Mol Biol., vol. 4, Article 17, pp. i-ii and 1-43, doi: 10.2202/1544-6115.1128 (2005).
International Search Report and Written Opinion for PCT/US2020/032696, mailed Oct. 13, 2020.
Liu, et al., "Plant Synthetic Promoters and Transcription Factors," Current Opinion in Biotechnology, vol. 37, pp. 36-44, and update pp. 1-2 (2016).

\* cited by examiner

MODIFIED PLANTS COMPRISING A POLYNUCLEOTIDE COMPRISING A NON-COGNATE PROMOTER OPERABLY LINKED TO A CODING SEQUENCE THAT ENCODES A TRANSCRIPTION FACTOR

STATEMENT OF GOVERNMENT SPONSORED RESEARCH

This invention was made with government support under Contract No. DE-SC0018269 awarded by the United States Department of Energy. The government has certain rights in the invention.

FIELD OF THE INVENTION

The present invention relates generally to modified plants comprising a polynucleotide comprising a promoter operably linked to a coding sequence, and more particularly to such plants wherein the coding sequence encodes a transcription factor that has at least 30% sequence identity to one or more of SEQ ID NOs: 27, 204, 10, 19, 1-9, 11-18, 20-26, 28-203, 205, 237, or 242-310, and the promoter is non-cognate with respect to the coding sequence.

BACKGROUND OF THE INVENTION

The world faces a major challenge in the next 35 years to meet the increased demands for food production to feed a growing global population, which is expected to reach 9 billion by the year 2050. Food output will need to be increased by up to 60% in view of the growing population.

Major agricultural crops include food crops, such as maize, wheat, oats, barley, soybean, millet, sorghum, potato, pulse, bean, tomato, rice, cassava, sugar beets, and potatoes, among others, forage crop plants, such as hay, alfalfa, and silage corn, among others, and oilseed crops, such as camelina, *Brassica* species (e.g. *B. napus* (canola), *B. rapa, B. juncea,* and *B. carinata*), crambe, soybean, sunflower, safflower, oil palm, flax, and cotton, among others. Crop yield can also be reduced as a consequence of weather patterns, such as heat waves, freezing temperatures, drought or flooding conditions in a particular growing season. With intensive farming practices crop pests or diseases can also reduce yield.

During the late 1980's and early 1990's genetic engineering or transgenic plants were used for the first time to develop crops which are herbicide tolerant and/or pest or disease resistant by introducing genes from the most readily available source at the time, microorganisms, to impart these new functionalities. Unfortunately, "transgenic plants" or "GMO crops" or "biotech traits" are not widely accepted in a number of different jurisdictions and are subject to regulatory approval processes which are very time consuming and prohibitively expensive. The current regulatory framework for transgenic plants results in significant costs (~$136 million per trait; McDougall, P. 2011, *The cost and time involved in the discovery, development, and authorization of a new plant biotechnology derived trait. Crop Life International*, website: //croplife.org/wp-content/uploads/pdf files/Getting-a-Biotech-Crop-to-Market-Phillips-McDougall-Study.pdf) and lengthy product development timelines that limit the number of technologies that are brought to market. These risks have severely impaired private investment and the adoption of innovation in this crucial sector. Recent advances in genome editing technologies provide an opportunity to precisely remove or inactivate specific plant genes or to alter their expression by modifying their promoter sequences to improve plant performance (Belhaj, K. 2013, Plant Methods, 9, 39; Khandagale & Nadal, 2016, Plant Biotechnol Rep, 10, 327). More importantly genome editing enables the ability to do this with combinations of gene targets either sequentially or simultaneously. The challenge then is to identify which genes to modify by genome editing to improve plant performance.

Plant scientists have been able to identify the ancient ancestors of modern major agricultural crops and have begun to map the key genetic changes that have taken place through the crop domestication process resulting in these crops. Many of these changes have resulted from the modification of the activity of key plant regulator genes or transcription factors. A classic example is the domestication of modern corn from the ancient plant Teosinte (Matsuoka, Y. et al., 2002, PNAS, 99, 6080-6084). Today we know that the modern corn genome contains around 39,000 genes and about 2,500 of these are transcription factors (Lin, et. al., 2014, BMC Genomics, 15, 818-820). Based on the teosinte-domestication-to-corn analogy it might seem reasonable to assume that by altering the activity of a relatively small number of transcription factors in plants used for food and feed production, significant improvements in crop performance could be achieved. For example it may be possible to improve the performance of corn substantially using genome editing tools to modify the expression of transcription factor genes. However, simple analysis explains why it is not feasible to consider testing these one by one and/or in all combinations. To test all two-transcription-factor-gene combinations would require over 3.3 million individual experiments.

Clearly there is a need to develop systems and approaches to identifying small numbers of transcription factors whose expression can be modified alone or in combinations to improve crop performance.

BRIEF SUMMARY OF THE INVENTION

It is an object of the current invention to provide methods, materials and plants useful for identifying a number of transcription factor genes, and transcription factor gene combinations, as targets for modification to improve crop performance. It is a further objective of this invention to provide DNA and RNA sequences for modifying or editing these transcription factor genes and transcription factor gene combinations to modulate their expression or activity and improve the performance of plants.

Plants of interest include a crop plant, a model plant, a monocotyledonous plant, a dicotyledonous plant, a plant with C3 photosynthesis, a plant with C4 photosynthesis, an annual plant, or a perennial plant. More preferably, the crop is selected from *Camelina sativa*, canola, soybean, maize, rice, and wheat, crops where seed is the harvested product.

The modified crop exhibits one or more enhanced characteristics selected from higher seed yield, improved harvest index, higher individual seed weight, higher seed oil content, faster seed germination and plant emergence, improved seedling vigor, higher photosynthesis rates, reduced photorespiration rates, improved nutritional composition, drought resistance, flood resistance, disease resistance, higher $CO_2$ assimilation rate, and lower transpiration rate relative to a control plant.

A modified plant is provided. The modified plant comprises a polynucleotide comprising a promoter operably linked to a coding sequence, wherein:
(a) the coding sequence encodes a transcription factor that has at least 30% sequence identity to one or more of SEQ ID NOs: 27, 204, 10, 19, 1-9, 11-18, 20-26, 28-203, 205, 237, or 242-310; and
(b) the promoter is non-cognate with respect to the coding sequence.

In some embodiments, the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27. In some of these embodiments, the transcription factor comprises SEQ ID NO: 27.

In some embodiments, the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204. In some of these embodiments, the transcription factor comprises SEQ ID NO: 204.

In some embodiments, the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10. In some of these embodiments, the transcription factor comprises SEQ ID NO: 10.

In some embodiments, the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19. In some of these embodiments, the transcription factor comprises SEQ ID NO: 19.

In some embodiments, the modified plant comprises the polynucleotide based on introduction of the polynucleotide by a transformation procedure. In some of these embodiments, the non-cognate promoter comprises a constitutive promoter. Also in some of these embodiments, the non-cognate promoter comprises a seed-specific promoter. Also in some of these embodiments, the modified plant exhibits increased expression of the transcription factor in at least one tissue in comparison to a reference plant not comprising the polynucleotide. In some of these embodiments, the at least one tissue comprises a seed tissue.

In some embodiments, the coding sequence occurs naturally at a location in the genome of the modified plant, and the modified plant comprises the polynucleotide based on editing of an endogenous promoter that is operably linked to the coding sequence at the location in the genome to make the non-cognate promoter operably linked to the coding sequence at the location in the genome. In some of these embodiments, the editing increases strength of the non-cognate promoter in comparison to the endogenous promoter. Also in some of these embodiments, the editing increases tissue specificity of the non-cognate promoter in comparison to the endogenous promoter. Also in some of these embodiments, the modified plant exhibits increased expression of the transcription factor in at least one tissue in comparison to a reference plant not comprising the polynucleotide. In some of these embodiments, the at least one tissue comprises a seed tissue.

In some embodiments, the modified plant is *Camelina sativa*, canola, soybean, maize, rice, or wheat. In some of these embodiments, the modified plant is *Camelina sativa*.

In some embodiments, the modified plant has one or more of the following traits:
(i) a seed yield that is at least 5% higher, at least 10% higher, at least 20% higher, at least 40% higher, at least 60% higher, at least 80% higher, or at least 100% higher in comparison to a reference plant not comprising the polynucleotide; or
(ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

A method for producing a modified plant having increased seed yield and/or oil content in comparison to a reference plant by transformation also is provided. The method comprises:
(1) transforming one or more host plants or plant cells with a genetic construct comprising a polynucleotide comprising a promoter operably linked to a coding sequence, wherein:
(a) the coding sequence encodes a transcription factor that has at least 30% sequence identity to one or more of SEQ ID NOs: 27, 204, 10, 19, 1-9, 11-18, 20-26, 28-203, 205, 237, or 242-310; and
(b) the promoter is non-cognate with respect to the coding sequence, and
(2) selecting a transformed plant or plant cell in which the polynucleotide is stably maintained, thereby obtaining the modified plant, wherein the reference plant does not comprise the polynucleotide.

In some embodiments, the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27. In some of these embodiments, the transcription factor comprises SEQ ID NO: 27.

In some embodiments, the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204. In some of these embodiments, the transcription factor comprises SEQ ID NO: 204.

In some embodiments, the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10. In some of these embodiments, the transcription factor comprises SEQ ID NO: 10.

In some embodiments, the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19. In some of these embodiments, the transcription factor comprises SEQ ID NO: 19.

In some embodiments, the non-cognate promoter comprises a constitutive promoter.

In some embodiments, the non-cognate promoter comprises a seed-specific promoter.

In some embodiments, the modified plant exhibits increased expression of the transcription factor in at least one tissue in comparison to the reference plant. In some of these embodiments, the at least one tissue comprises a seed tissue.

In some embodiments, the modified plant is *Camelina sativa*, canola, soybean, maize, rice, or wheat. In some of these embodiments, the modified plant is *Camelina sativa*.

In some embodiments, the modified plant has one or more of the following traits:

(i) a seed yield that is at least 5% higher, at least 10% higher, at least 20% higher, at least 40% higher, at least 60% higher, at least 80% higher, or at least 100% higher in comparison to a reference plant not comprising the polynucleotide; or (ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

A method for producing a modified plant having increased seed yield and/or oil content in comparison to a reference plant by editing also is provided. The method comprises:

(1) editing the genome of one or more host plants or plant cells to comprise a polynucleotide comprising a promoter operably linked to a coding sequence, wherein:
   (a) the coding sequence encodes a transcription factor that has at least 30% sequence identity to one or more of SEQ ID NOs: 27, 204, 10, 19, 1-9, 11-18, 20-26, 28-203, 205, 237, or 242-310;
   (b) the promoter is non-cognate with respect to the coding sequence;
   (c) the coding sequence occurs naturally at a location in the genome; and
   (d) the editing is of an endogenous promoter that is operably linked to the coding sequence at the location in the genome to make the non-cognate promoter operably linked to the coding sequence at the location in the genome, and (2) selecting an edited plant or plant cell in which the polynucleotide is stably maintained, thereby obtaining the modified plant, wherein the reference plant does not comprise the polynucleotide.

In some embodiments, the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27. In some of these embodiments, the transcription factor comprises SEQ ID NO: 27.

In some embodiments, the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204. In some of these embodiments, the transcription factor comprises SEQ ID NO: 204.

In some embodiments, the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10. In some of these embodiments, the transcription factor comprises SEQ ID NO: 10.

In some embodiments, the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19. In some of these embodiments, the transcription factor comprises SEQ ID NO: 19.

In some embodiments, the editing increases strength of the non-cognate promoter in comparison to the endogenous promoter.

In some embodiments, the editing increases tissue specificity of the non-cognate promoter in comparison to the endogenous promoter.

In some embodiments, the modified plant exhibits increased expression of the transcription factor in at least one tissue in comparison to a reference plant not comprising the polynucleotide. In some of these embodiments, the at least one tissue comprises a seed tissue.

In some embodiments, the modified plant is *Camelina sativa*, canola, soybean, maize, rice, or wheat. In some of these embodiments, the modified plant is *Camelina sativa*.

In some embodiments, the modified plant has one or more of the following traits:

(i) a seed yield that is at least 5% higher, at least 10% higher, at least 20% higher, at least 40% higher, at least 60% higher, at least 80% higher, or at least 100% higher in comparison to a reference plant not comprising the polynucleotide; or (ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

Exemplary embodiments include the following:

Embodiment 1. A modified plant comprising a polynucleotide comprising a promoter operably linked to a coding sequence, wherein:
(a) the coding sequence encodes a transcription factor that has at least 30% sequence identity to one or more of SEQ ID NOs: 27, 204, 10, 19, 1-9, 11-18, 20-26, 28-203, 205, 237, or 242-310; and
(b) the promoter is non-cognate with respect to the coding sequence.

Embodiment 2. The modified plant according to embodiment 1, wherein the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27.

Embodiment 3. The modified plant according to embodiment 2, wherein the transcription factor comprises SEQ ID NO: 27.

Embodiment 4: The modified plant according to embodiment 1, wherein the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204.

Embodiment 5: The modified plant according to embodiment 4, wherein the transcription factor comprises SEQ ID NO: 204.

Embodiment 6: The modified plant according to embodiment 1, wherein the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10.

Embodiment 7: The modified plant according to embodiment 6, wherein the transcription factor comprises SEQ ID NO: 10.

Embodiment 8: The modified plant according to embodiment 1, wherein the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19.

Embodiment 9: The modified plant according to embodiment 8, wherein the transcription factor comprises SEQ ID NO: 19.

Embodiment 10: The modified plant according to any one of embodiments 1-9, wherein the modified plant comprises the polynucleotide based on introduction of the polynucleotide by a transformation procedure.

Embodiment 11: The modified plant according to embodiment 10, wherein the non-cognate promoter comprises a constitutive promoter.

Embodiment 12: The modified plant according to embodiment 10, wherein the non-cognate promoter comprises a seed-specific promoter.

Embodiment 13: The modified plant according to any one of embodiments 10-12, wherein the modified plant exhibits increased expression of the transcription factor in at least one tissue in comparison to a reference plant not comprising the polynucleotide.

Embodiment 14: The modified plant according to embodiment 13, wherein the at least one tissue comprises a seed tissue.

Embodiment 15: The modified plant according to any one of embodiments 1-14, wherein the coding sequence occurs naturally at a location in the genome of the modified plant, and the modified plant comprises the polynucleotide based on editing of an endogenous promoter that is operably linked to the coding sequence at the location in the genome to make the non-cognate promoter operably linked to the coding sequence at the location in the genome.

Embodiment 16: The modified plant according to embodiment 15, wherein the editing increases strength of the non-cognate promoter in comparison to the endogenous promoter.

Embodiment 17: The modified plant according to embodiment 15 or 16, wherein the editing increases tissue specificity of the non-cognate promoter in comparison to the endogenous promoter.

Embodiment 18: The modified plant according to any one of embodiments 15-17, wherein the modified plant exhibits increased expression of the transcription factor in at least one tissue in comparison to a reference plant not comprising the polynucleotide.

Embodiment 19: The modified plant according to embodiment 18, wherein the at least one tissue comprises a seed tissue.

Embodiment 20: The modified plant according to any one of embodiments 1-19, wherein the modified plant is *Camelina sativa*, canola, soybean, maize, rice, or wheat.

Embodiment 21: The modified plant according to embodiment 20, wherein the modified plant is *Camelina sativa*.

Embodiment 22: The modified plant according to any one of embodiments 1-21, wherein the modified plant has one or more of the following traits:
  (i) a seed yield that is at least 5% higher, at least 10% higher, at least 20% higher, at least 40% higher, at least 60% higher, at least 80% higher, or at least 100% higher in comparison to a reference plant not comprising the polynucleotide; or
  (ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

Embodiment 23: A method for producing a modified plant having increased seed yield and/or oil content in comparison to a reference plant by transformation, the method comprising:
  (1) transforming one or more host plants or plant cells with a genetic construct comprising a polynucleotide comprising a promoter operably linked to a coding sequence, wherein:
    (a) the coding sequence encodes a transcription factor that has at least 30% sequence identity to one or more of SEQ ID NOs: 27, 204, 10, 19, 1-9, 11-18, 20-26, 28-203, 205, 237, or 242-310; and
    (b) the promoter is non-cognate with respect to the coding sequence, and
  (2) selecting a transformed plant or plant cell in which the polynucleotide is stably maintained, thereby obtaining the modified plant, wherein the reference plant does not comprise the polynucleotide.

Embodiment 24: The method according to embodiment 23, wherein the transcription factor is an ortholog of LOB domain-containing protein 42-like protein of *Arabidopsis thaliana* and has at least 30% sequence identity to SEQ ID NO: 27.

Embodiment 25: The method according to embodiment 24, wherein the transcription factor comprises SEQ ID NO: 27.

Embodiment 26: The method according to embodiment 23, wherein the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204.

Embodiment 27: The method according to embodiment 26, wherein the transcription factor comprises SEQ ID NO: 204.

Embodiment 28: The method according to embodiment 23, wherein the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10.

Embodiment 29: The method according to embodiment 28, wherein the transcription factor comprises SEQ ID NO: 10.

Embodiment 30: The method according to embodiment 23, wherein the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19.

Embodiment 31: The method according to embodiment 30, wherein the transcription factor comprises SEQ ID NO: 19.

Embodiment 32: The method according to any one of embodiment 23-31, wherein the non-cognate promoter comprises a constitutive promoter.

Embodiment 33: The method according to any one of embodiments 23-31, wherein the non-cognate promoter comprises a seed-specific promoter.

Embodiment 34: The method according to any one of embodiments 23-33, wherein the modified plant exhibits increased expression of the transcription factor in at least one tissue in comparison to the reference plant.

Embodiment 35: The method according to embodiment 34, wherein the at least one tissue comprises a seed tissue.

Embodiment 36: The method according to any one of embodiments 23-35, wherein the modified plant is *Camelina sativa*, canola, soybean, maize, rice, or wheat.

Embodiment 37: The method according to embodiment 36, wherein the modified plant is *Camelina sativa*.

Embodiment 38: The method according to any one of embodiments 23-37, wherein the modified plant has one or more of the following traits:
 (i) a seed yield that is at least 5% higher, at least 10% higher, at least 20% higher, at least 40% higher, at least 60% higher, at least 80% higher, or at least 100% higher in comparison to a reference plant not comprising the polynucleotide; or
 (ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

Embodiment 39: A method for producing a modified plant having increased seed yield and/or oil content in comparison to a reference plant by editing, the method comprising:
 (1) editing the genome of one or more host plants or plant cells to comprise a polynucleotide comprising a promoter operably linked to a coding sequence, wherein:
  (a) the coding sequence encodes a transcription factor that has at least 30% sequence identity to one or more of SEQ ID NOs: 27, 204, 10, 19, 1-9, 11-18, 20-26, 28-203, 205, 237, or 242-310;
  (b) the promoter is non-cognate with respect to the coding sequence;
  (c) the coding sequence occurs naturally at a location in the genome; and
  (d) the editing is of an endogenous promoter that is operably linked to the coding sequence at the location in the genome to make the non-cognate promoter operably linked to the coding sequence at the location in the genome, and
 (2) selecting an edited plant or plant cell in which the polynucleotide is stably maintained, thereby obtaining the modified plant, wherein the reference plant does not comprise the polynucleotide.

Embodiment 40: The method according to embodiment 39, wherein the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27.

Embodiment 41: The method according to embodiment 40, wherein the transcription factor comprises SEQ ID NO: 27.

Embodiment 42: The method according to embodiment 39, wherein the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204.

Embodiment 43: The method according to embodiment 42, wherein the transcription factor comprises SEQ ID NO: 204.

Embodiment 44: The method according to embodiment 39, wherein the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10.

Embodiment 45: The method according to embodiment 44, wherein the transcription factor comprises SEQ ID NO: 10.

Embodiment 46: The method according to embodiment 39, wherein the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19.

Embodiment 47: The method according to embodiment 46, wherein the transcription factor comprises SEQ ID NO: 19.

Embodiment 48: The method according to any one of embodiments 39-47, wherein the editing increases strength of the non-cognate promoter in comparison to the endogenous promoter.

Embodiment 49: The method according to any one of embodiments 39-48, wherein the editing increases tissue specificity of the non-cognate promoter in comparison to the endogenous promoter.

Embodiment 50: The method according to any one of embodiments 39-49, wherein the modified plant exhibits increased expression of the transcription factor in at least one tissue in comparison to a reference plant not comprising the polynucleotide.

Embodiment 51: The method according to embodiment 50, wherein the at least one tissue comprises a seed tissue.

Embodiment 52: The method according to any one of embodiments 39-51, wherein the modified plant is *Camelina sativa*, canola, soybean, maize, rice, or wheat.

Embodiment 53: The method according to embodiment 52, wherein the modified plant is *Camelina sativa*.

Embodiment 54: The method according to any one of embodiments 39-53, wherein the modified plant has one or more of the following traits:
 (i) a seed yield that is at least 5% higher, at least 10% higher, at least 20% higher, at least 40% higher, at least 60% higher, at least 80% higher, or at least 100% higher in comparison to a reference plant not comprising the polynucleotide; or
 (ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

DETAILED DESCRIPTION OF THE INVENTION

Figure 1:
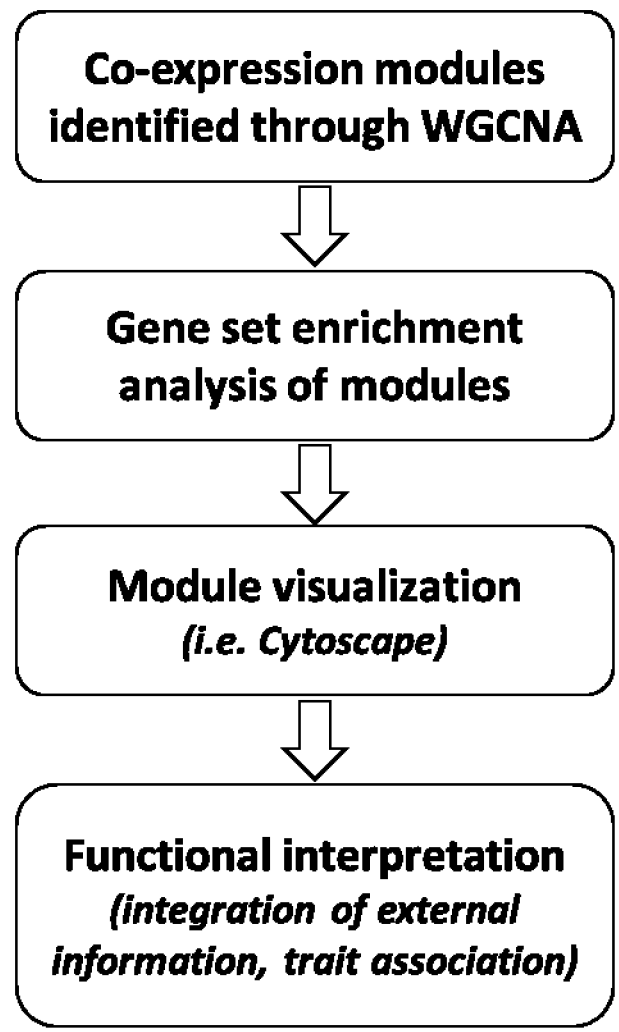
FIG. 1 illustrates the work flow for analysis of the co-expression modules identified through Weighted Gene Co-expression Network Analysis (WGCNA).

The following terms, unless otherwise indicated, shall be understood to have the following meanings:

As used herein we use the terms "crops" and "plants" interchangeably.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" or "recombinant expression construct", which are used interchangeably, refers to any gene that is not a native gene, comprising regulatory and coding sequences that are not found together in nature. A "Cis-genic gene" is a chimeric gene where the DNA sequences making up the gene are from the same plant species or a sexually compatible plant species where the cis-genic gene is deployed in the same species from which the DNA sequences were obtained. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure. As used herein the term "coding sequence" refers to a DNA sequence which codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to, promoters, translation leader sequences, introns, and polyadenylation recognition sequences. As used herein "gene" includes protein coding regions of the specific genes and the regulatory sequences both 5' and 3' which control the expression of the gene.

As used herein a "modified plant" refers to non-naturally occurring plants or crops engineered as described throughout herein.

As used herein a "control plant" means a plant that has not been modified as described in the present disclosure to impart an enhanced trait or altered phenotype. A control plant is used to identify and select a modified plant that has an enhanced trait or altered phenotype. For instance, a control plant can be a plant that has not been modified or has not been genome edited to express or to inhibit its endogenous gene product. A suitable control plant can be a non-transgenic plant of the parental line used to generate a transgenic plant, for example, a wild type plant devoid of a recombinant DNA. A suitable control plant can also be a transgenic plant that contains recombinant DNA that imparts other traits, for example, a transgenic plant having enhanced herbicide tolerance. A suitable control plant can in some cases be a progeny of a hemizygous transgenic plant line that does not contain the recombinant DNA, known as a negative segregant, or a negative isogenic line.

As used herein the term "seed oil yield" or "seed oil content" refers to oil content of a seed as measured, e.g., expressed on the basis of seed dry weight.

As used herein the term "seed yield" refers to an increase or decrease in the % weight in an amount greater than an otherwise identical plant, cultured under identical conditions, but lacking any corresponding modification, e.g., gene editing or the transgene in a control plant.

As used herein the terms "biomass yield" or "biomass content" refer to increase or decrease in the % dry weight in an amount greater than an otherwise identical plant, cultured under identical conditions, but lacking any corresponding modification, e.g., gene editing or the transgene in a control plant.

As used herein, the terms "increase activity", "increase expression" or "upregulated" are used interchangeably and mean the activity of the transcription factor is increased or higher than the expression of the same gene in the same plant species before the gene was modified as described herein. The term also encompasses the situation where the activity of the transcription factor gene is upregulated in a tissue or at a stage of plant development as compared to the activity of the transcription factor gene in the tissue or developmental stage before the gene was modified. Upregulation should be understood to include an increase in the level or activity of a target gene in a cell and/or an increase in the expression of a particular target polypeptide in a cell which normally expresses the target polypeptide. For instance, a 1%, 5%, 10%, 20%, 30%, 40%, 50%, 60%, 70%, 80%, 90%, 100%, 2-fold, 5-fold, 10-fold, 20-fold, 50-fold, 100-fold increase in the level of activity of a target polypeptide in the cell. With respect to term "2-fold increase", "upregulated 2-fold" and 100% increase are used interchangeably.

As used herein, the terms "reduce activity," "reduce expression," "decreased activity," "decreased expression," "down-regulating," or "downregulated" are used interchangeably and mean the activity of the transcription factor is reduced or lower than the expression of the same gene in the same plant species before the gene was modified as described herein. Downregulation should be understood to include a decrease in the level or activity of a target gene in a cell and/or substantially complete inhibition of a particular target polypeptide in a cell which normally expresses the target polypeptide. For instance, a 1%, 5%, 10%, 20%, 30%, 40%, 50%, 60%, 70%, 80%, 90%, 100%, 2-fold, 5-fold, 10-fold, 20-fold, 50-fold, 100-fold decrease in the level of activity of a target polypeptide in the cell. With respect to term "2-fold reduction", "downregulated 2-fold" and 100% decrease is used interchangeably.

"Codon degeneracy" refers to divergence in the genetic code permitting variation of the nucleotide sequence without affecting the amino acid sequence of an encoded polypeptide. Accordingly, the instant invention relates to any nucleic acid fragment comprising a nucleotide sequence that encodes all or a substantial portion of the amino acid sequences set forth herein. The skilled artisan is well aware of the "codon-bias" exhibited by a specific host cell in usage of nucleotide codons to specify a given amino acid. Therefore, when synthesizing a nucleic acid fragment for increased expression in a host cell, it is desirable to design the nucleic acid fragment such that its frequency of codon usage approaches the frequency of preferred codon usage of the host cell.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity). When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percent sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

As used herein, "percent sequence identity" means the value determined by comparing two aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percent sequence identity.

The "percent sequence identity" between two or more polypeptides can be determined, for example, by using the ALIGNX alignment function of the Vector NTI software package (Vector NTI Advance, Version 11.5.3, ThermoFisher), which uses the Clustal W algorithm. Default parameters of the program can be used. The percentage of sequence identity between three or more polypeptides can be determined by using the Clustal Omega Multiple Sequence Alignment Tool (website: www.ebi.ac.uk/Tools/msa/clustalo/). Default parameters can be used. The percentage of sequence identity between two polypeptides also can be determined by making a pairwise sequence alignment. This can be done using EMBOSS Needle Pairwise Sequence Alignment (PROTEIN) tool using default settings (matrix: BLOSUM62; gap open: 10; gap extend: 0.5; output format: pair; end gap penalty: false; end gap open: 10; end gap extend: 0.5) (website: ebi.ac.uk/Tools/psa/emboss_needle/). This also can be done using other pairwise sequence alignment tools that are analogous.

The term "plant" includes whole plant, mature plants, seeds, shoots and seedlings, and parts, propagation material, plant organ tissue, protoplasts, callus and other cultures, for example cell cultures, derived from plants belonging to the plant subkingdom Embryophyta, and all other species of groups of plant cells giving functional or structural units, also belonging to the plant subkingdom Embryophyta. The term "mature plants" refers to plants at any developmental stage beyond the seedling. The term "seedlings" refers to young, immature plants at an early developmental stage.

PREFERRED EMBODIMENTS

The present disclosure relates to transcription factor genes in specific crop species whose expression or activity can be modulated to increase crop performance and crops having increased or reduced expression of these transcription factor genes alone and in combinations which have improved performance compared to the same plants with normal expression levels of these genes. Also disclosed are specific transcription factor gene sequences, DNA sequences, protein sequences and materials and methods for modifying plant cells and plants such that they have increased or reduced expression of the transcription factor genes, methods for identifying plant cells and plants with increased or reduced expression of the transcription factor genes and methods for producing fertile plants with increased or reduced expression of the transcription factor genes wherein the modified plants have improved performance as compared to the same plants before they were modified to increase or reduce the expression of these genes.

Transcriptome-based gene regulatory association networks can be used to identify transcription factors associated with a trait (Skraly et al., 2018, Plant Science, 273, 23-32). These networks have been previously used to identify transcription factors associated with starch biosynthesis (Fu et al., 2010, Plant Physiol., 154, 927-938), higher grain yield and stress tolerance (Ambavaram et al., 2014, Nat. Commun., 5, 5302), seed desiccation tolerance (Gonzalez-Morales et al., 2016, PNAS, 113, E5232-E5241), and wheat spike architecture (Wang et al., 2017, Plant Physiol., 175, 746-757).

Transcriptome-based gene regulatory association networks are generated using expression data obtained from RNA sequencing (RNA-SEQ) or microarray analysis of plants. Large-scale data sets from plants grown under a variety of conditions are available for some plants from public databases and are useful for creating these co-expression networks to probe the transcriptional organization of a particular plant and to identify key transcription factors that control a trait.

In various aspects, the present invention provides transcription factor genes useful for practicing the disclosed invention and include, depending on the identity of the transcription factor, those that can function as negative controllers or feedback controllers, or those that can function as positive controllers in plants. Plants evolved over millennia simply to survive and reproduce before the involvement of humans to domesticate specific plants which we recognize today as the major food and feed crops. During the domestication process the intervention of humans either through agronomic practices or through crop breeding led to the "unnatural" selection of crops for specific purposes, for example corn for grain yield, and sorghum and alfalfa for forage applications. There is genetic evidence from the domestication of teosinte to corn (maize) that the downregulation or reduced expression of transcription factors was important in achieving the performance and grain yield of the modern crop. Transcription factors function to either increase the activity of specific metabolic pathways or gene regulatory networks in plants or to decrease them. Herein we have identified transcription factors in crops some of which may act as negative controllers of key plant systems related to crop performance, and other which may act as positive controllers. It is well known in the field of metabolic engineering (synthetic biology) that a key to increasing the yield of a particular target product is to remove the negative control steps in the metabolic systems or pathways related to the target of interest. Without wishing to be bound by the theory, we believe one way to significantly improve the performance of crops is to identify and remove or down regulate key negative control points alone and in combinations in plant genes involved in gene regulation and metabolism.

It is also well known in the field of metabolic engineering that some regulators are positive regulators and that a key to increasing the yield of a particular target product is to increase the expression of these genes to improve the metabolic efficiency of the metabolic systems or pathways related to the target of interest. Without wishing to be bound by the theory, we believe one way to significantly improve the performance of crops is to identify these positive regulators and increase their expression alone and in combinations in plant genes involved in gene regulation and metabolism.

Herein we disclose transcription factor genes that have been identified through the use of co-expression networks. Using co-expression networks built on Camelina sativa RNA-Sequencing data, transcription factors (TFs) predicted to increase seed yield and/or oil content in oilseeds were identified.

Depending on the targeted TF and its function in plant metabolism, it may be desirable to increase its expression, reduce its expression, or eliminate its expression. Methods are described to enable each of these expression strategies.

Modified Plants

A modified plant is provided. The modified plant comprises a polynucleotide comprising a promoter operably linked to a coding sequence.

The coding sequence encodes a transcription factor that has at least 30% sequence identity to one or more of SEQ ID NOs: 27, 204, 10, 19, 1-9, 11-18, 20-26, 28-203, 205, 237, or 242-310.

SEQ ID NO: 27 is a predicted LOB domain-containing protein 42-like protein (also termed LBD42) transcription factor of Camelina sativa. The corresponding Camelina sativa gene (SEQ ID NO: 238) was identified as a candidate gene for engineering increased seed yield and/or oil content in an oilseed based on being a Hub gene in a co-expression network, as discussed below. The Camelina sativa LBD42 protein is predicted to be a LOB domain-containing protein 42-like protein transcription factor based in part on sharing 95.71% sequence identity with LOB domain-containing protein 42-like protein of Arabidopsis thaliana (SEQ ID NO: 311). Predicted orthologs include LBD42 proteins in soybean (SEQ ID NO: 318), canola (SEQ ID NO: 322), and rice (SEQ ID NO: 326). The Camelina sativa LBD42 protein shares 55.20%, 89.74%, and 54.50% sequence identities with these orthologs, respectively.

Accordingly, in some embodiments, the transcription factor is an ortholog of LOB domain-containing protein 42-like protein of Arabidopsis thaliana and has at least 30%, 40%, 50%, 60%, 70%, 80%, 90%, 95%, 96%, 97%, 98%, or 99% sequence identity to SEQ ID NO: 27. In some embodiments, the transcription factor comprises one or more of SEQ ID NO: 27, SEQ ID NO: 318, SEQ ID NO: 322, or SEQ ID NO: 326. In some embodiments, the transcription factor comprises SEQ ID NO: 27.

Also, in some embodiments the transcription factor is LOB domain-containing protein 42-like protein of Arabidopsis thaliana of SEQ ID NO: 311.

SEQ ID NO: 204 is a predicted zinc finger CCCH domain-containing protein 54-like protein (also termed PEI1) transcription factor of Camelina sativa. The corresponding Camelina sativa gene (SEQ ID NO: 239) was identified as a candidate gene for engineering increased seed yield and/or oil content in an oilseed based on (1) its high correlation to pathways that influence seed yield and/or oil content, (2) its strong expression at early, mid, and late seed developmental stages, and (3) the unique regulation of target genes by PEI1 as predicted by PlantRegMap, as discussed below. The Camelina sativa PEI1 protein is predicted to be a zinc finger CCCH domain-containing protein 54-like protein transcription factor based in part on sharing 89.34%% sequence identity with zinc finger CCCH domain-containing protein 54-like protein of Arabidopsis thaliana (SEQ ID NO: 312). Predicted orthologs include PEI1 proteins in maize (SEQ ID NO: 315), soybean (SEQ ID NO: 319), canola (SEQ ID NO: 323), and rice (SEQ ID NO: 327). The Camelina sativa PEI1 protein shares 42.92%, 37.61%, 81.48%, and 41.67% sequence identities with these orthologs, respectively.

Accordingly, in some embodiments, the transcription factor is an ortholog of zinc finger CCCH domain-containing protein 54-like protein of Arabidopsis thaliana and has at least 30%, 40%, 50%, 60%, 70%, 80%, 90%, 95%, 96%, 97%, 98%, or 99% sequence identity to SEQ ID NO: 204. In some embodiments, the transcription factor comprises one or more of SEQ ID NO: 204, SEQ ID NO: 315, SEQ ID NO: 319, SEQ ID NO: 323, or SEQ ID NO: 327. In some embodiments, the transcription factor comprises SEQ ID NO: 204.

Also, in some embodiments the transcription factor is zinc finger CCCH domain-containing protein 54-like protein of Arabidopsis thaliana of SEQ ID NO: 312.

SEQ ID NO: 10 is a predicted dof zinc finger protein DOF4.4-like protein (also termed DOF4.4) transcription factor of Camelina sativa. The corresponding Camelina sativa gene (SEQ ID NO: 240) was identified as a candidate gene for engineering increased seed yield and/or oil content in an oilseed based on being a Hub gene in a co-expression network, as discussed below. The Camelina sativa DOF4.4 protein is predicted to be a dof zinc finger protein DOF4.4-like protein transcription factor based in part on sharing 47.80% sequence identity with dof zinc finger protein DOF4.4-like protein of Arabidopsis thaliana (SEQ ID NO: 313). Predicted orthologs include DOF4.4 proteins in maize (SEQ ID NO: 316), soybean (SEQ ID NO: 320), canola (SEQ ID NO: 324), and rice (SEQ ID NO: 328). The Camelina sativa DOF4.4 protein shares 39.15%, 38.30%, 55.31%, and 32.00% sequence identities with these orthologs, respectively.

Accordingly, in some embodiments, the transcription factor is an ortholog of dof zinc finger protein DOF4.4-like protein of Arabidopsis thaliana and has at least 30%, 40%, 50%, 60%, 70%, 80%, 90%, 95%, 96%, 97%, 98%, or 99% sequence identity to SEQ ID NO: 10. In some embodiments, the transcription factor comprises one or more of SEQ ID NO: 10, SEQ ID NO: 316, SEQ ID NO: 320, SEQ ID NO: 324, or SEQ ID NO: 328. In some embodiments, the transcription factor comprises SEQ ID NO: 10.

Also, in some embodiments the transcription factor is dof zinc finger protein DOF4.4-like protein of Arabidopsis thaliana of SEQ ID NO: 313.

SEQ ID NO: 19 is a predicted putative two-component response regulator ARR21 protein (also termed ARR21) transcription factor of Camelina sativa. The corresponding Camelina sativa gene (SEQ ID NO: 241) was identified as a candidate gene for engineering increased seed yield and/or oil content in an oilseed based on being a Hub gene in a co-expression network, as discussed below. The *Camelina sativa* ARR21 protein is predicted to be a putative two-component response regulator ARR21 protein transcription factor based in part on sharing 72.76% sequence identity with putative two-component response regulator ARR21 protein of *Arabidopsis thaliana* (SEQ ID NO: 314). Predicted orthologs include ARR21 proteins in maize (SEQ ID NO: 317), soybean (SEQ ID NO: 321), canola (SEQ ID NO: 325), and rice (SEQ ID NO: 329). The *Camelina sativa* ARR21 protein shares 22.75%, 31.21%, 63.80%, and 28.60% sequence identities with these orthologs, respectively.

Accordingly, in some embodiments, the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19. In some embodiments, the transcription factor comprises one or more of SEQ ID NO: 19, SEQ ID NO: 321, or SEQ ID NO: 325. In some embodiments, the transcription factor comprises SEQ ID NO: 19.

Also, in some embodiments the transcription factor is putative two-component response regulator ARR21 protein of *Arabidopsis thaliana* of SEQ ID NO: 314.

As noted above, the modified plant comprises a polynucleotide comprising a promoter operably linked to a coding sequence.

The promoter is non-cognate with respect to the coding sequence. This means that the promoter is not naturally paired with the coding sequence in organisms from which the promoter and/or the coding sequence are derived. Instead, the promoter has been paired with the nucleic acid sequence based on use of recombinant DNA techniques and/or gene editing to create a modified gene including the non-cognate promoter operably linked to the coding sequence, as discussed in detail below. For example, the promoter may be a heterologous promoter that has been operably linked to the coding sequence by replacement of an endogenous promoter of the coding sequence, e.g. through recombinant DNA techniques. Also for example the promoter may be a modified promoter operably linked to the coding sequence based on mutation of an endogenous promoter operably linked to the coding sequence, e.g. through gene editing.

In some embodiments, the modified plant comprises the polynucleotide based on introduction of the polynucleotide by a transformation procedure. In some of these embodiments, the non-cognate promoter comprises a constitutive promoter. Suitable exemplary constitutive promoters are described below.

Also in some of these embodiments, the non-cognate promoter comprises a seed-specific promoter. Suitable exemplary seed-specific promoters are discussed below.

Also in some of these embodiments, the modified plant exhibits increased expression of the transcription factor in at least one tissue in comparison to a reference plant not comprising the polynucleotide. The expression may be increased, for example, by 1%, 5%, 10%, 20%, 30%, 40%, 50%, 60%, 70%, 80%, 90%, 100%, or more. The reference plant can be, for example, a plant of the same species, cultivar, and/or variety from which the modified plant was generated. In some of the embodiments, the at least one tissue in which expression of the transcription factor is increased comprises a seed tissue.

In some embodiments, the coding sequence occurs naturally at a location in the genome of the modified plant, and the modified plant comprises the polynucleotide based on editing of an endogenous promoter that is operably linked to the coding sequence at the location in the genome to make the non-cognate promoter operably linked to the coding sequence at the location in the genome, as discussed below. In some of these embodiments, the editing increases strength of the non-cognate promoter in comparison to the endogenous promoter. Also in some of these embodiments, the editing increases tissue specificity of the non-cognate promoter in comparison to the endogenous promoter. Also in some of these embodiments, the modified plant exhibits increased expression of the transcription factor in at least one tissue in comparison to a reference plant not comprising the polynucleotide. The expression may be increased, for example, by 1%, 5%, 10%, 20%, 30%, 40%, 50%, 60%, 70%, 80%, 90%, 100%, or more. The reference plant can be, for example, a plant of the same species, cultivar, and/or variety from which the modified plant was generated. In some of these embodiments, the at least one tissue in which expression of the transcription factor is increased comprises a seed tissue.

In some embodiments, the modified plant is *Camelina sativa*, canola, soybean, maize, rice, or wheat. In some of these embodiments, the modified plant is *Camelina sativa*.

In some embodiments, the modified plant has one or more of the following traits:
(i) a seed yield that is at least 5% higher, at least 10% higher, at least 20% higher, at least 40% higher, at least 60% higher, at least 80% higher, or at least 100% higher in comparison to a reference plant not comprising the polynucleotide; or
(ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

Seed yield can be determined by weighing seeds, as discussed below. Seed oil content can be measured using published procedures for preparation of fatty acid methyl esters (Malik et al. 2015, Plant Biotechnology Journal, 13, 675-688). The reference plant can be, for example, a plant of the same species, cultivar, and/or variety from which the modified plant was generated.

Methods for Producing Modified Plants by Transformation

A method for producing a modified plant having increased seed yield and/or oil content in comparison to a reference plant by transformation also is provided.

The method comprises transforming one or more host plants or plant cells with a genetic construct comprising a polynucleotide comprising a promoter operably linked to a coding sequence. Transformation of the one or more host plants or plant cells can be carried out, for example, as described below.

The coding sequence encodes a transcription factor that has at least 30% sequence identity to one or more of SEQ ID NOs: 27, 204, 10, 19, 1-9, 11-18, 20-26, 28-203, 205, 237, or 242-310, as discussed above.

The promoter is non-cognate with respect to the coding sequence, also as discussed above.

The method also comprises selecting a transformed plant or plant cell in which the polynucleotide is stably maintained, thereby obtaining the modified plant. Selection can be carried out, for example, as described below.

The reference plant does not comprise the polynucleotide. The reference plant can be, for example, a plant of the same species, cultivar, and/or variety as the one or more host plants or plant cells.

In some embodiments, the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27, as discussed above. In some embodiments, the transcription factor comprises SEQ ID NO: 27.

In some embodiments, the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204, as discussed above. In some embodiments, the transcription factor comprises SEQ ID NO: 204.

In some embodiments, the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10, as discussed above. In some embodiments, the transcription factor comprises SEQ ID NO: 10.

In some embodiments, the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19, as discussed above. In some embodiments, the transcription factor comprises SEQ ID NO: 19.

In some embodiments, the non-cognate promoter comprises a constitutive promoter. In some embodiments, the non-cognate promoter comprises a seed-specific promoter. In some embodiments, the modified plant exhibits increased expression of the transcription factor in at least one tissue in comparison to the reference plant. In some of these embodiments, the at least one tissue comprises a seed tissue.

In some embodiments, the modified plant is *Camelina sativa*, canola, soybean, maize, rice, or wheat. In some of these embodiments, the modified plant is *Camelina sativa*.

In some embodiments, the modified plant has one or more of the following traits:

(i) a seed yield that is at least 5% higher, at least 10% higher, at least 20% higher, at least 40% higher, at least 60% higher, at least 80% higher, or at least 100% higher in comparison to a reference plant not comprising the polynucleotide; or (ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

Methods for Producing Modified Plants by Editing

A method for producing a modified plant having increased seed yield and/or oil content in comparison to a reference plant by editing also is provided.

The method comprises editing the genome of one or more host plants or plant cells to comprise a polynucleotide comprising a promoter operably linked to a coding sequence. The editing can be carried out, for example, as described below.

The coding sequence encodes a transcription factor that has at least 30% sequence identity to one or more of SEQ ID NOs: 27, 204, 10, 19, 1-9, 11-18, 20-26, 28-203, 205, 237, or 242-310, as discussed above. The promoter is non-cognate with respect to the coding sequence, also as discussed above.

The coding sequence occurs naturally at a location in the genome. Thus, the coding sequence is present in the genome of the one or more host plants or plant cells, prior to the editing.

The editing is of an endogenous promoter that is operably linked to the coding sequence at the location in the genome. The editing modifies the endogenous promoter, e.g. by introducing one or more point mutations, insertions, deletions, or replacement sequences. The resulting modified promoter is thus non-cognate with respect to the coding sequence. The non-cognate promoter operably linked to the coding sequence at the location in the genome is thus obtained.

The method also includes selecting an edited plant or plant cell in which the polynucleotide is stably maintained, thereby obtaining the modified plant. Selection can be carried out, for example, as described below.

The reference plant does not comprise the polynucleotide. The reference plant can be, for example, a plant of the same species, cultivar, and/or variety as the one or more host plants or plant cells.

In some embodiments, the transcription factor is an ortholog of LOB domain-containing protein 42-like protein of *Arabidopsis thaliana* and has at least 30%, 40%, 50%, 60%, 70%, 80%, 90%, 95%, 96%, 97%, 98%, or 99% sequence identity to SEQ ID NO: 27, as discussed above. In some embodiments, the transcription factor comprises SEQ ID NO: 27.

In some embodiments, the transcription factor is an ortholog of zinc finger CCCH domain-containing protein 54-like protein of *Arabidopsis thaliana* and has at least 30%, 40%, 50%, 60%, 70%, 80%, 90%, 95%, 96%, 97%, 98%, or 99% sequence identity to SEQ ID NO: 204, as discussed above. In some embodiments, the transcription factor comprises SEQ ID NO: 204.

In some embodiments, the transcription factor is an ortholog of dof zinc finger protein DOF4.4-like protein of *Arabidopsis thaliana* and has at least 30%, 40%, 50%, 60%, 70%, 80%, 90%, 95%, 96%, 97%, 98%, or 99% sequence identity to SEQ ID NO: 10, as discussed above. In some embodiments, the transcription factor comprises SEQ ID NO: 10.

In some embodiments, the transcription factor is an ortholog of putative two-component response regulator ARR21 protein of *Arabidopsis thaliana* and has at least 30%, 40%, 50%, 60%, 70%, 80%, 90%, 95%, 96%, 97%, 98%, or 99% sequence identity to SEQ ID NO: 19, as discussed above. In some embodiments, the transcription factor comprises SEQ ID NO: 19.

In some embodiments, the editing increases strength of the non-cognate promoter in comparison to the endogenous promoter. In some embodiments, the editing increases tissue specificity of the non-cognate promoter in comparison to the endogenous promoter. In some embodiments, the modified plant exhibits increased expression of the transcription factor in at least one tissue in comparison to a reference plant not comprising the polynucleotide. In some of these embodiments, the at least one tissue comprises a seed tissue.

In some embodiments, the modified plant is *Camelina sativa*, canola, soybean, maize, rice, or wheat. In some of these embodiments, the modified plant is *Camelina sativa*.

In some embodiments, the modified plant has one or more of the following traits:
(i) a seed yield that is at least 5% higher, at least 10% higher, at least 20% higher, at least 40% higher, at least 60% higher, at least 80% higher, or at least 100% higher in comparison to a reference plant not comprising the polynucleotide; or
(ii) a seed oil content that is at least 5% higher, at least 10% higher, at least 20% higher, at least 40% higher, at least 60% higher, at least 80% higher, or at least 100% higher in comparison to a reference plant not comprising the polynucleotide.

Recombinant Techniques and Gene Editing

In some embodiments, the polynucleotide is downregulated by techniques or various new technologies developed and/or used to create new characteristics in plants through genetic variation, the aim being targeted mutagenesis, targeted introduction of new genes or gene silencing (RdDM). Examples of such new breeding techniques are targeted sequence changes facilitated through the use of Zinc finger nuclease (ZFN) technology (ZFN-1, ZFN-2 and ZFN-3, see U.S. Pat. No. 9,145,565, incorporated by reference in its entirety), Oligonucleotide directed mutagenesis (ODM), Cisgenesis and intragenesis, RNA-dependent DNA methylation (RdDM, which does not necessarily change nucleotide sequence but can change the biological activity of the sequence), Grafting (on GM rootstock), Reverse breeding, Agro-infiltration (agro-infiltration "sensu stricto", agro-inoculation, floral dip), Transcription Activator-Like Effector Nucleases (TALENs, see U.S. Pat. Nos. 8,586,363 and 9,181,535, incorporated by reference in their entireties), the CRISPR/Cas system (see U.S. Pat. Nos. 8,697,359; 8,771,945; 8,795,965; 8,865,406; 8,871,445; 8,889,356; 8,895,308; 8,906,616; 8,932,814; 8,945,839; 8,993,233; and 8,999,641), engineered meganuclease re-engineered homing endonucleases, DNA guided genome editing (Gao et al., Nature Biotechnology (2016), doi: 10.1038/nbt.3547, incorporated by reference in its entirety), and synthetic genomics. A complete description of each of these techniques can be found in the report made by the Joint Research Center (JRC) Institute for Prospective Technological Studies of the European Commission in 2011 and titled "New plant breeding techniques—State-of-the-art and prospects for commercial development."

Modulation of candidate transcription factor genes is performed through known techniques in the art, such as without limitation, by genetic means, enzymatic techniques, chemicals methods, or combinations thereof. Inactivation may be conducted at the level of DNA, mRNA or protein, and inhibit the expression of one or more candidate transcription factor genes or the corresponding activity. Preferred inactivation methods affect the expression of the transcription factor gene and lead to the absence of gene product in the plant cells. It should be noted that the inhibition can be transient or permanent or stable. Inhibition of the protein can be obtained by suppressing or decreasing its activity or by suppressing or decreasing the expression of the corresponding gene. For example, a mutation in the coding sequence can induce, depending upon the nature of the mutation, expression of an inactive protein, or of a reduced-active protein; a mutation at a splicing site can also alter or abolish the protein's function; a mutation in the promoter sequence can induce the absence of expression of said protein, or the decrease of its expression. Mutagenesis can be performed, e.g., by suppressing all or part of the coding sequence or of the promoter, or by inserting an exogenous sequence, e.g., a transposon, into said coding sequence or said promoter. It can also be performed by inducing point mutations, e.g., using ethyl methanesulfonate (EMS) mutagenesis or radiation. The mutated alleles can be detected, e.g., by PCR, by using specific primers of the gene. Rodriguez-Leal et al. describe a promoter editing method that generates a pool of promoter variants that can be screened to evaluate their phenotypic impact (Rodriguez-Leal et al., 2017, Cell, 171, 1-11). This method can be incorporated to downregulate native promoters of each transcription factor in the crop of interest.

Various high-throughput mutagenesis and splicing methods are described in the prior art. By way of examples, we may cite "TILLING" (Targeting Induced Local Lesions In Genome)-type methods, described by Till, Comai and Henikoff (2007) (R. K. Varshney and R. Tuberosa (eds.), Genomics-Assisted Crop Improvement: Vol. 1: Genomics Approaches and Platforms, 333-349.).

Plants comprising a mutation in the candidate transcription factor genes that induce inhibition of the protein product are also part of the goal. This mutation can be, e.g., a deletion of all or part of the coding sequence or of the promoter, or it may be a point mutation of said coding sequence or of said promoter.

Advantageously, inhibition of the transcription factor protein is obtained by silencing or by knock-out techniques on the transcription factor gene. Various techniques for silencing genes in plants are known. Antisense inhibition or co suppression, described, e.g., in Hamilton and Baulcombe, 1999, Science, vol 286, pp 950-952, is noteworthy. It is also possible to use ribozymes targeting the mRNA of one or more transcription factor protein. Preferably, silencing of the transcription factor gene is induced by RNA interference targeting said gene. An interfering RNA (iRNA) is a small RNA that can silence a target gene in a sequence-specific way. Interfering RNA include, specifically, "small interfering RNA" (siRNA) and micro-RNA (miRNA). The most widely-used constructions lead to the synthesis of a pre-miRNA in which the target sequence is present in sense and antisense orientation and separated by a short spacing region. The sense and antisense sequence can hybridize together leading to the formation of a hairpin structure called the pre miRNA. This hairpin structure is maturated leading to the production of the final miRNA. This miRNA will hybridize to the target mRNA which will be cleaved or degraded, as described in Schwab et al (Schwab et al, 2006 The Plant Cell, Vol. 18, 1121-1133) or in Ossowski et al (Ossowski et al, 2008, The plant Journal 53, 674-690).

Inhibition of the transcription factor proteins can also be obtained by gene editing of the candidate transcription factor genes. Various methods can be used for gene editing, by using transcription activator-like effector nucleases (TALENs), clustered Regularly Interspaced Short Palindromic Repeats (CRISPR/Cas9) or zinc-finger nucleases (ZFN) techniques (as described in Belhaj et al, 2013, Plant Methods, vol 9, p 39, Chen et al, 2014 Methods Volume 69, Issue 1, p 2-8). Preferably, the inhibition of a transcription factor protein is obtained by using Clustered Regularly Interspaced Short Palindromic Repeats (CRISPR/Cas9) or CRISPR/Cpf1. The use of this technology in genome editing is well described in the art, for example in Fauser et al. (Fauser et al, 2014, The Plant Journal, Vol 79, p 348-359), and references cited herein. In short, CRISPR is a microbial nuclease system involved in defense against invading phages and plasmids. CRISPR loci in microbial hosts contain a combination of CRISPR-associated (Cas) genes as well as noncoding RNA elements capable of programming the specificity of the CRISPR-mediated nucleic acid cleavage (sgRNA). At least classes (Class I and II) and six types (Types I-VI) of Cas proteins have been identified across a wide range of bacterial hosts. One key feature of each CRISPR locus is the presence of an array of repetitive sequences (direct repeats) interspaced by short stretches of non-repetitive sequences (spacers). The non-coding CRISPR array is transcribed and cleaved within direct repeats into short crRNAs containing individual spacer sequences, which direct Cas nucleases to the target site (protospacer). The Type II CRISPR/Cas is one of the most well characterized systems and carries out targeted DNA double-strand break in four sequential steps. First, two non-coding RNA, the pre-crRNA array and tracrRNA, are transcribed from the CRISPR locus. Second, tracrRNA hybridizes to the repeat regions of the pre-crRNA and mediates the processing of pre-crRNA into mature crRNAs containing individual spacer sequences. Third, the mature crRNA: tracrRNA complex directs Cas9 to the target DNA via Watson-Crick base-pairing between the spacer on the crRNA and the protospacer on the target DNA next to the protospacer adjacent motif (PAM), an additional requirement for target recognition. Finally, Cas9 mediates cleavage of target DNA to create a double-stranded break within the protospacer. Cas9 is thus the hallmark protein of the Type II CRISPR-Cas system, and a large monomeric DNA nuclease guided to a DNA target sequence adjacent to the PAM (protospacer adjacent motif) sequence motif by a complex of two noncoding RNAs: CRISPR RNA (crRNA) and trans-activating crRNA (tracrRNA). The Cas9 protein contains two nuclease domains homologous to RuvC and HNH nucleases. The HNH nuclease domain cleaves the complementary DNA strand whereas the RuvC-like domain cleaves the non-complementary strand and, as a result, a blunt cut is introduced in the target DNA. Heterologous expression of Cas9 together with an sgRNA can introduce site-specific double strand breaks (DSBs) into genomic DNA of live cells from various organisms. For applications in eukaryotic organisms, codon optimized versions of Cas9, which is originally from the bacterium *Streptococcus pyogenes*, have been used. The single guide RNA (sgRNA) is the second component of the CRISPR/Cas system that forms a complex with the Cas9 nuclease. sgRNA is a synthetic RNA chimera created by fusing crRNA with tracrRNA. The sgRNA guide sequence located at its 5' end confers DNA target specificity. Therefore, by modifying the guide sequence, it is possible to create sgRNAs with different target specificities. The canonical length of the guide sequence is 20 bp. In plants, sgRNAs have been expressed using plant RNA polymerase III promoters, such as U6 and U3. Cas9 expression plasmids for use in the methods of the invention can be constructed as described in the art.

Kocak et al., (2019, Nature Biotechnology, 10.1038/s41587-019-0095-1) have described methods for increasing the specificity of sgRNAs by engineering a hairpin sequence that can only be undone by the target sequence. This method can be used to increase the sgRNA specificity in the practiced invention.

The absence of or loss of function in modified engineered plants or plant cells can be verified based on the phenotypic characteristics of their offspring; homozygous plants or plant cells for a mutation inactivating the transcription factor gene have a content of gene product rate that is lower than that of the wild plants (not carrying the mutation in the gene) from which they originated. Alternatively, a desirable phenotypic characteristic such as biomass yield, seed yield, or seed oil content is measured and is at least 10% higher, preferably at least 20% higher, at least preferably 30% higher, preferably at least 40% higher, preferably at least 50% higher than that of the control plants from which they originated. More preferably, seed yield or seed oil content is at least 60% higher, at least 70% higher, at least 80% higher, at least 90% higher than that of the control plants from which they originated. More preferably, seed yield or seed oil content is at least 100% higher, at least 150% higher, at least 200% higher than that of the control plants from which they originated.

The expression of the target gene or genes in the crops of interest can be reduced by any method known in the art, including the transgene based expression of antisense RNA or interfering RNA (RNAi) e.g., siRNA or miRNA or through genome editing to modify the DNA sequence of the genes disclosed herein directly in the plant cell chromosome.

Figure 4:
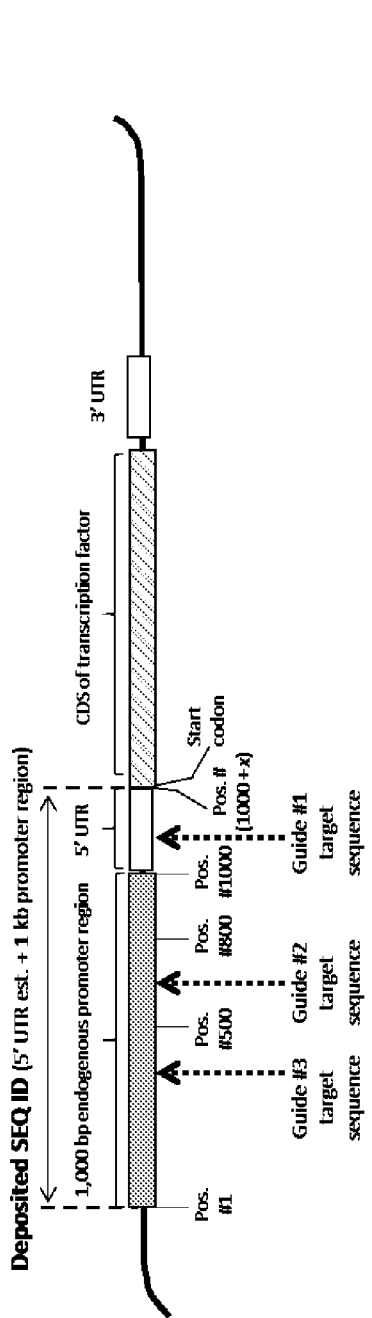
FIG. 4 illustrates the strategy for promoter replacement to change the expression pattern of a transcription factor using CRISPR genome editing. A. Guide target sequences (~20 nt) in genomic DNA that are adjacent to a 3' PAM sequence of (NGG) are identified in the region of the endogenous promoter to be replaced. DNA cassettes encoding sgRNA (See FIG. 3A) are designed to bind the genomic DNA at the identified guide target sequences to promote DNA cleavage and excision of the promoter DNA. In this example, guide target sequences identified for the design of three different sgRNAs are depicted in the promoter region. Pairs of sgRNAs can be used to excise regions of the promoter DNA for insertion of the new promoter replacement cassette, or alternatively, one sgRNA can be used. B. Cassettes for delivery into plant cells to achieve promoter replacement include i. a cassette to deliver the new promoter flanked by regions homologous to each side of the nuclease cut site [left and right flanking regions in (B), the flanking regions can additionally be flanked by guide target sequences and an adjacent PAM site to promote release of the cassette by Cas9 from a construct or other DNA]; ii. an expression cassette for the Cas9 nuclease or other site specific nuclease; and iii. an expression cassette(s) for DNA encoding sgRNAs to target cut sites that excise a portion or the whole promoter region. These cassettes can be transformed into the plant separately or on the same DNA through a variety of plant transformation methods including protoplast transformation, particle bombardment, nanotube or nanoparticle mediated DNA delivery (Kwak et al., 2019, Nature Nanotechnology, DOI 10.1038/s41565-019-0375-4) (Demirer et al, 2019, Nature Nanotechnology, DOI 10.1038/s41565-019-0382-5), and *Agrobacterium*-mediated transformation. The sgRNAs initiate a Cas9-induced double stranded DNA cleavage at the guide target sequence (or sgRNA binding site) in (A), whose sequence is complementary to the guide portion of the sgRNA. The regions of the promoter insertion cassette homologous to each side of the nuclease cut site direct the cassette's insertion into genomic DNA through the plants endogenous homology directed repair mechanism C. Alternatively, CRISPR mediated promoter replacement can be achieved through the use of Ribonucleoprotein complexes (RNPs). The RNPs are created from a promoter insertion cassette, purified Cas9 enzyme, and synthesized sgRNA1 and sgRNA3 molecules. RNPs can be created and transformed into protoplasts as previously described by Woo et al., Nature Biotechnology, 2015, 33, 1162-1164. Nanoparticles or nanotubes capable of delivering biomolecules to plants can also be used (for review see Cunningham, 2018, Trends Biotechnol., 36, 882). D. Structure of the edited plant genomic DNA containing the new heterologous promoter inserted at the positions of Guide target sequences #1 and #3, that is created through (B) genetic transformation of cassettes or (C) delivery of RNPs.
Figure 4:
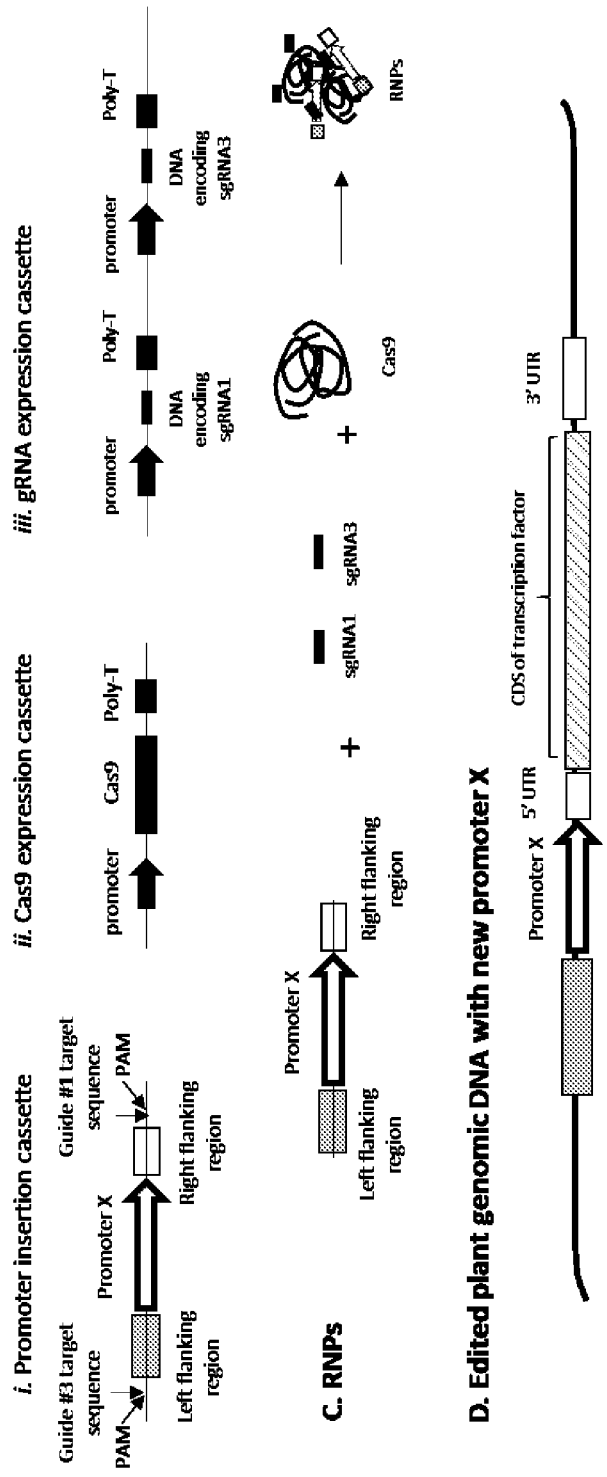
Figure 5:
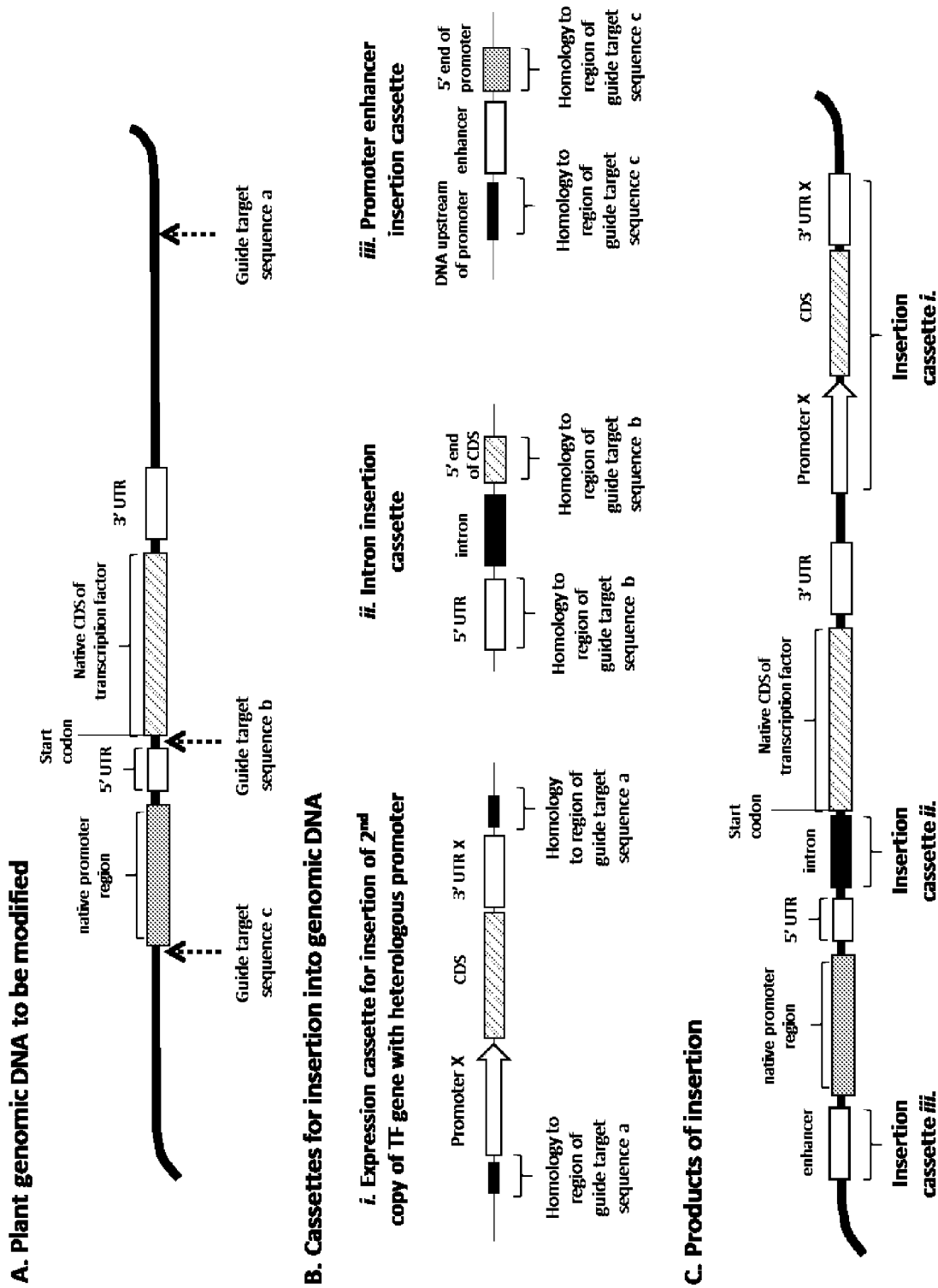
FIG. 5 illustrates cassettes for insertion into the genome at a Cas nuclease cleavage site to modulate the level of expression of the transcription factor. A. Schematic of the plant genomic DNA to be modified showing the positioning of three guide target DNA sequences (a, b, and c). The guide target sequences are adjacent to PAM sequences. B. Cassettes to be inserted to modulate expression of the transcription factor can be selected from one or more of the following: i. an expression cassette for a second copy of a transcription factor of interest containing a heterologous promoter (designated promoter x), the coding sequence (CDS) of the transcription factor, and a 3' UTR (designated 3'UTR X). In this example, the insertion of this cassette is targeted to a genomic region where an sgRNA capable of binding to guide target sequence a will initiate a Cas9-induced double stranded DNA cleavage. The promoter insertion cassette is flanked by regions homologous to each side of the nuclease cut site to direct the cassette's insertion through the plant's endogenous homology directed repair mechanism. ii. a cassette for insertion of an intron between the promoter and the start codon of the gene. In this example, the insertion of the intron cassette is targeted to a genomic region where an sgRNA capable of binding to guide target sequence b will initiate a Cas9-induced double stranded DNA cleavage in a region near the 5' UTR and the start codon of the transcription factor gene. The intron insertion cassette is flanked by regions homologous to each side of the nuclease cut site to direct the cassette's insertion through the plants endogenous homology directed repair mechanism. iii. a cassette for insertion of a promoter enhancer upstream of the endogenous promoter. In this example, the insertion of the enhancer cassette is targeted to a genomic region where an sgRNA capable of binding to guide target sequence c will initiate a Cas9-induced double stranded DNA cleavage. The enhancer insertion cassette is flanked by regions homologous to each side of the nuclease cut site to direct the cassette's insertion through the plant's endogenous homology directed repair mechanism. C. Illustration of the products of site-directed insertion for cassette i, ii, and/or iii into genomic DNA. While the illustration shows insertion of all three cassettes, one skilled in the art will understand that insertion(s) can be selected from one or more cassettes.
Figure 6:
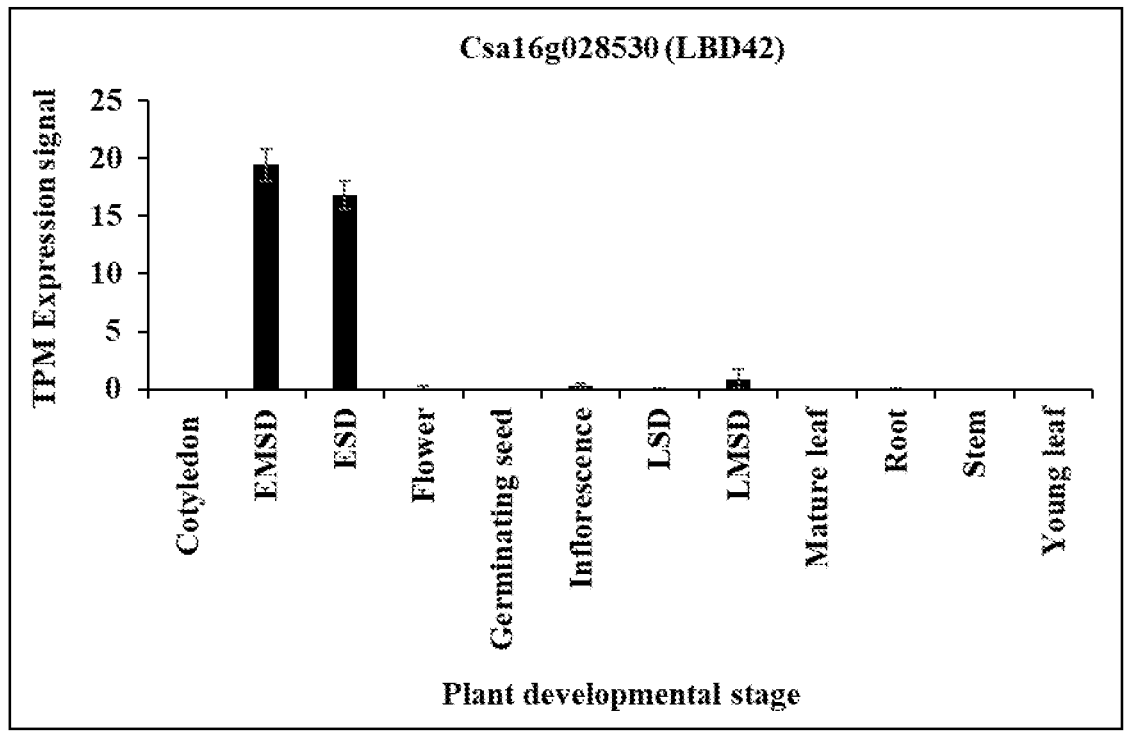
FIGS. 6-9 illustrate the in silico expression profile of LLBD42 (SEQ ID NO: 238), PEI1 (SEQ ID NO: 239), DOF4.4 (SEQ ID NO: 240), and ARR21 (SEQ ID NO: 241), respectively, in various organs and developmental tissues of Camelina. Data were retrieved from the Camelina Electronic Fluorescent Pictograph browser (website: //bar.utoronto.ca/efp_camelina/cgi-bin/efpWeb.cgi). Graphs depict the plant developmental stage on the x-axis and the expression signal in units of TPM (transcript per million) on the y-axis. The organs and developmental tissues are (1) cotyledon, (2) early mid seed development (EMSD), (3) early seed development (ESD), (4) flower, (5) germinating seed, (6) inflorescence, (7) late seed development (LSD), (8) late mid seed development (LMSD), (9) mature leaf, (10) root, (11) stem, and (12) young leaf.

In other embodiments, the polynucleotide is upregulated by techniques or new technologies developed and/or used to overexpress genes in plants, such as conventional transgenic technologies where a new expression cassette containing a promoter, the transcription factor of interest, and a terminator are inserted into the plant through for example *Agrobacterium*-mediated transformation, protoplast transformation, or nanotube mediated DNA delivery, all of which are well known in the art. CRISPR/Cas technologies or other technologies that create double stranded DNA breaks, such as TALENs or ZFN technologies, can also be used to insert the new expression cassette. Upregulation of the endogenous copy of the transcription factor can also be achieved by promoter replacement strategies (FIG. 4), insertion of an intron or a promoter enhancer cassette (FIG. 5), or editing of the endogenous promoter region to change its strength and/or tissue specificity.

Genome editing is a preferred method for practicing this invention. As used herein the terms "genome editing," "genome edited," and "genome modified" are used interchangeably to describe plants with specific DNA sequence changes in their genomes wherein those DNA sequence changes include changes of specific nucleotides, the deletion of specific nucleotide sequences or the insertion of specific nucleotide sequences.

As used herein "method for genome editing" includes all methods for genome editing technologies to precisely remove genes, gene fragments, to insert new DNA sequences into genes, to alter the DNA sequence of control sequences or protein coding regions to reduce or increase the expression of target genes in plant genomes (Belhaj, K. 2013, Plant Methods, 9, 39; Khandagale & Nadal, 2016, Plant Biotechnol Rep, 10, 327). Preferred methods involve the in vivo site-specific cleavage to achieve double stranded breaks in the genomic DNA of the plant genome at a specific DNA sequence using nuclease enzymes and the host plant DNA repair system. There are multiple methods to achieve double stranded breaks in genomic DNA, and thus achieve genome editing, including the use of zinc finger nucleases (ZFN), transcription activator-like effector nucleases (TALENs), engineered meganucleases, and the CRISPR/Cas system (CRISPR is an acronym for clustered, regularly interspaced, short, Ralindromic repeats and Cas an abbreviation for CRISPR-associated protein) (for review see Khandagal & Nadal, Plant Biotechnol Rep, 2016, 10, 327). US Patent Application 2016/0032297 to Dupont describes these methods in detail. In some cases, the sequence specificity for the target gene in the plant genome is dependent on engineering specific nuclease like zinc finger nucleases (ZFN), which include an engineered DNA-binding zinc finger domain linked to a non-specific endonuclease domain such as FokI, or Tal effector nuclease (TALENS) to recognize the target DNA sequence in the plant genome. The CRISPR/Cas genome editing system is a preferred method because of its sequence targeting flexibility. This technology requires a source of the Cas enzyme and a short single guide RNA (sgRNA, ~20 bp), DNA, RNA/DNA hybrid or double stranded DNA guide with sequence homology to the target DNA sequence in the plant genome to direct the Cas enzyme to the desired cut site for cleavage and a recognition sequence for binding the Cas enzyme. As used herein the term Cas nuclease includes any nuclease which site-specifically recognizes CRISPR sequences based on guide RNA or DNA sequences and includes Cas9, Cpf1 and others described below. CRISPR/Cas genome editing, is a preferred way to edit the genomes of complex organisms (Sander & Joung, 2013, Nat Biotech, 2014, 32, 347; Wright et al., 2016, Cell, 164, 29) including plants (Zhang et al., 2016, Journal of Genetics and Genomics, 43, 151; Puchta, H., 2016, Plant J., 87, 5; Khandagale & Nadaf, 2016, PLANT BIOTECHNOL REP, 10, 327). US Patent Application 2016/020822 to Dupont has an extensive description of the materials and methods useful for genome editing in plants using the CRISPR Cas9 system and describes many of the uses of the CRISPR/Cas9 system for genome editing of a range of gene targets in crops.

There are many variations of the CRISPR/Cas system that can be used for this technology including the use of wild-type Cas9 from *Streptococcus pyogenes* (Type II Cas) (Barakate & Stephens, 2016, Frontiers in Plant Science, 7, 765; Bortesi & Fischer, 2015, *Biotechnology Advances* 5, 33, 41; Cong et al., 2013, Science, 339, 819; Rani et al., 2016, Biotechnology Letters, 1-16; Tsai et al., 2015, Nature biotechnology, 33, 187), the use of a Tru-gRNA/Cas9 in which off-target mutations were significantly decreased (Fu et al., 2014, Nature biotechnology, 32, 279; Osakabe et al., 2016, Scientific Reports, 6, 26685; Smith et al., 2016, Genome biology, 17, 1; Zhang et al., 2016, Scientific Reports, 6, 28566), a high specificity Cas9 (mutated *S. pyogenes* Cas9) with little to no off target activity (Kleinstiver et al., 2016, Nature 529, 490; Slaymaker et al., 2016, Science, 351, 84), the Type I and Type III Cas Systems in which multiple Cas proteins need to be expressed to achieve editing (Li et al., 2016, Nucleic acids research, 44:e34; Luo et al., 2015, Nucleic acids research, 43, 674), the Type V Cas system using the Cpf1 enzyme (Kim et al., 2016, Nature biotechnology, 34, 863; Toth et al., 2016, Biology Direct, 11, 46; Zetsche et al., 2015, Cell, 163, 759), DNA-guided editing using the NgAgo Argonaute enzyme from *Natronobacterium gregoryi* that employs guide DNA (Xu et al., 2016, Genome Biology, 17, 186), and the use of a two vector system in which Cas9 and gRNA expression cassettes are carried on separate vectors (Cong et al., 2013, Science, 339, 819). A unique nuclease Cpf1, an alternative to Cas9 has advantages over the Cas9 system in reducing off-target edits which creates unwanted mutations in the host genome. Examples of crop genome editing using the CRISPR/Cpf1 system include rice (Tang et. al., 2017, Nature Plants 3, 1-5; Wu et. al., 2017, Molecular Plant, Mar. 16, 2017) and soybean (Kim et. al., 2017, Nat Commun. 8, 14406).

Methods for constructing the genome modified plant cells and plants include introducing into plant cells a site-specific nuclease to cleave the plant genome at the target site or target sites and the guide sequences. Modification to the DNA sequence at the cleavage site then occur through the plant cells natural DNA repair processes. In a preferred case using the CRISPR system the target site in the plant genome is determined by providing guide RNA sequences.

A "guide polynucleotide" also relates to a polynucleotide sequence that can form a complex with a Cas endonuclease and enables the Cas endonuclease to recognize and optionally cleave a DNA target site. The guide polynucleotide can be a single molecule or a double molecule. The guide polynucleotide sequence can be a RNA sequence, a DNA sequence, or a combination thereof (a RNA-DNA combination sequence).

As used herein "guide RNA" sequences comprise a variable targeting domain, homologous to the target site in the genome and an RNA sequence that interacts with the Cas9 or Cpf1 endonuclease. This variable targeting domain is referred to herein and within the examples as a "guide targeting sequence". A guide polynucleotide that solely comprises ribonucleic acids is also referred to as a "guide RNA".

Preferred embodiments include multiplex of gene edits. The method also provides introducing single-guide RNAs (sgRNAs) into plants. The guide RNAs (sgRNAs) include nucleotide sequences that are complementary to the target chromosomal DNA. The sgRNAs can be, for example, engineered single chain guide RNAs that comprise a crRNA sequence (complementary to the target DNA sequence) and a common tracrRNA sequence, or as crRNA-tracrRNA hybrids. The sgRNAs can be introduced into the cell or the organism as a DNA with an appropriate promoter, as an in vitro transcribed RNA, or as a synthesized RNA. Methods for designing the guide RNAs for any target gene of interest are well known in the art as described for example by Brazelton et al. (Brazelton, V. A. et al., 2015, GM Crops & Food, 6, 266-276) and Zhu (Zhu, L. J. 2015, Frontiers in Biology, 10, 289-296).

Examples of mutations that may lead to a reduced activity of a transcription factor protein are mutations to the coding sequence that give rise to premature stop codons, frame shifts or amino acid changes in the encoded protein. A single guide RNA can be used where the objective is to change a relatively small number of base pairs in the DNA and for example introduce frame-shift mutations resulting in the expression of an inactive or reduced activity protein. Premature stop codons typically lead to the expression of a truncated version of the encoded protein. Depending on the position of the mutation in the coding sequence, a truncated version of a protein may lack one or more domains that are essential to perform its function and/or to interact with substrates or with other proteins, and/or it may lack the ability to fold properly into a functional protein.

In certain preferred embodiments, the guide polynucleotide/Cas endonuclease system can be used to allow for the deletion of a promoter or promoter element of any one the transcription factor sequences of the invention, wherein the promoter deletion (or promoter element deletion) results in any one of the following or any one combination of the following: a permanently inactivated gene locus, an increased promoter activity (increased promoter strength), an increased promoter tissue specificity, a decreased promoter activity, a decreased promoter tissue specificity, a new promoter activity, an inducible promoter activity, an extended window of gene expression, a modification of the timing or developmental progress of gene expression, a mutation of DNA binding elements and/or an addition of DNA binding elements. Promoter elements to be deleted can be, but are not limited to, promoter core elements, promoter enhancer elements or 35 S enhancer elements (CaMV35S enhancers (Benfey et al, EMBO J, August 1989; 8(8): 2195-2202)). The promoter or promoter fragment to be deleted can be endogenous, artificial, pre-existing, or transgenic to the cell that is being edited.

In another embodiment, the guide polynucleotide/Cas endonuclease system can be used to allow for the deletion of a terminator or terminator element of any one the transcription factor sequences of the invention, wherein the terminator deletion (or terminator element deletion) results in any one of the following or any one combination of the following: an increased terminator activity (increased terminator strength), an increased terminator tissue specificity, a decreased terminator activity, a decreased terminator tissue specificity, a mutation of DNA binding elements and/or an addition of DNA binding elements. The terminator or terminator fragment to be deleted can be endogenous, artificial, pre-existing, or transgenic to the cell that is being edited.

In yet another embodiment, the genomic sequence of interest to be modified is an intron site of any one the transcription factor sequences of the invention, wherein the modification consists of inserting an intron enhancing motif into the intron which results in modulation of the transcriptional activity of the gene comprising said intron.

In a further embodiment, methods provide for modifying alternative splicing sites of any one of the transcription factor sequences of the invention resulting in enhanced production of the functional gene transcripts and gene products (proteins).

In additional embodiments, the modification of the transcription factor sequences of the invention include editing the intron borders of alternatively spliced genes to alter the accumulation of splice variants.

In other embodiments, the guide polynucleotide/Cas endonuclease system can be used to modify or replace a coding sequence of the TF genome of a plant cell, wherein the modification or replacement results in any one of the following, or any one combination of the following: an increased protein (enzyme) activity, an increased protein functionality, a decreased protein activity, a decreased protein functionality, a site specific mutation, a protein domain swap, a protein knock-out, a new protein functionality, a modified protein functionality.

In some embodiments, the protein knockout is due to the introduction of a stop codon into the coding sequence of interest. In preferred embodiments, the protein knockout is due to the deletion of a start codon into the coding sequence of interest. In yet other embodiments, the guide polynucleotide/Cas endonuclease system can be used with or without a co-delivered polynucleotide sequence to fuse a first coding sequence encoding a nuclear localization signal to a second coding sequence encoding a protein of interest, wherein the protein fusion results in targeting the protein of interest to the nuclease.

The guide RNA/Cas endonuclease system can be used to create frame shift mutations of any one of the transcription factor sequences of the invention. One or more guide RNAs are used to knockout the transcription factor genes after the Cas nuclease makes a double strand break and the error prone DNA repair pathway, non-homologous end joining, corrects the break, creating a mutation. The most likely result is a frameshift mutation that would knockout the gene. The targeting strategy involves finding proto-spacers in the exons of the gene that had a PAM sequence, NGG, and was unique in the genome.

The guide RNA/Cas endonuclease system can be used to allow for the deletion of a promoter element from any one of the transcription factor sequences of the invention. Promoter elements, such as enhancer elements, are often introduced in promoters driving gene expression cassettes in multiple copies for trait gene testing or to produce transgenic plants expressing a specific trait. Enhancer elements can be, but are not limited to, a 35S enhancer element (Benfey et al, EMBO J, August 1989; 8(8): 2195-2202). In some plants (events), the enhancer elements can cause an unwanted phenotype, a yield drag, or a change in expression pattern of the trait of interest that is not desired. It may be desired to remove the extra copies of the enhancer element while keeping the trait gene cassettes intact at their integrated genomic location. The guide RNA/Cas endonuclease can be used to remove the unwanted enhancing element from the plant genome. A guide RNA can be designed to contain a variable targeting region, or "guide target sequence" targeting a sequence of 12-30 bps adjacent to a NGG (PAM) in the enhancer. The Cas endonuclease can make cleavage to remove one or multiple enhancers. The guide RNA/Cas endonuclease system can be introduced by either *Agrobacterium* or particle gun bombardment. Alternatively, two different guide RNAs (targeting two different genomic target sites) can be used to remove multiple enhancer elements from the genome of a plant.

In some embodiments, the genome modified plant has improved performance as compared to a plant of the same type which does not have the genome modification. The improved performance of the genome modified plant includes for example, higher seed yield, improved harvest index, higher oil content, improved nutritional composition, higher photosynthesis rates, reduced photorespiration rates, higher biomass yield, drought resistance, flood resistance, disease resistance, faster seed germination and plant emergence, and/or improved seedling vigor. The genome modified plant can have a $CO_2$ assimilation rate that is higher than for a corresponding control plant not comprising the genome modification.

The genome modified plant can have a seed yield that is higher than for a corresponding control plant not comprising the genome modification. For example, the genome modified plant can have a seed yield that is at least 5% higher, at least 10% higher, at least 20% higher, at least 40% higher, at least 60% higher, at least 80% higher or at least 100% higher, than for a corresponding control plant not comprising the genome modification.

The genome modified plant can have a seed oil content that is higher than for a corresponding control plant not comprising the genome modification. For example, the genome modified plant can have a seed oil content that is at least 5% higher, at least 10% higher, at least 20% higher, at least 40% higher, at least 60% higher, at least 80% higher or at least 100% higher, than for a corresponding control plant not comprising the genome modification.

Plants of Interest

Plants encompass all annual and perennial monocotyledonous or dicotyledonous plants. Preferred dicotyledonous plants are selected in particular from the dicotyledonous crop plants such as sunflower, lettuce, the genus *Brassica*, very particularly the species *napus* (oilseed rape), *campestris* (beet), *oleracea* cv Tastie (cabbage), *oleracea* cv Snowball Y (cauliflower) and *oleracea* cv Emperor (broccoli), cabbage, melon, pumpkin/squash or zucchini and others; soybean, alfalfa, pea, beans, peanut, tomato, potato, sweet potato, yams carrot, flax, cotton, hemp, cucumber, spinach, carrot, sugar beet and the various tree, nut and grapevine species, in particular banana and kiwi fruit. Preferred monocotyledonous plants include maize, rice, wheat, sugarcane, sorghum, oats and barley.

Of particular interest are oilseed plants including *Camelina* (false flax); *Brassica* species such as *B. campestris, B.*

*napus*, *B. rapa*, *B. carinata* (mustard, oilseed rape or turnip rape); *Cannabis sativa* (hemp); *Carthamus tinctorius* (safflower); *Cocos nucifera* (coconut); *Crambe abyssinica* (*crambe*); *Elaeis guinensis* (African oil palm); *Elaeis oleifera* (American oil palm); *Glycine max* (soybean); *Gossypium hirsutum* (American cotton); *Gossypium barbadense* (Egyptian cotton); *Gossypium herbaceum* (Asian cotton); *Helianthus annuus* (sunflower); *Jatropha curcas* (jatropha); *Linum usitatissimum* (linseed or flax); *Oenothera biennis* (evening primrose); *Olea europaea* (olive); *Oryza sativa* (rice); *Ricinus communis* (castor); *Sesamum indicum* (sesame); *Thlaspi caerulescens* (pennycress); *Triticum* species (wheat); *Zea mays* (maize or corn), and various nut species such as, for example, walnut or almond.

Plants where the seed is a harvested product, including those selected from the group corn (maize), grain sorghum, millet, soybean, canola, cotton, wheat, rice, pulses, sunflower, safflower and *Camelina* are examples of particularly useful plants for performance improvement using the methods, target genes for altered expression to achieve improved plant performance and genome inserts to alter the expression of the target gene(s) are disclosed herein.

Transcription factor genes, including crop-specific transcription factor gene sequences in preferred crop species useful as targets for down regulation, alone or in combinations, to improve crop performance are described herein. Methods of downregulating these genes in these crops including site-specific nucleases, guide RNAs, guide RNA-DNA hybrids and guide DNAs, DNA constructs useful in the methods are described herein. Methods for introducing the site-specific nuclease and guide RNAs into plant cells and plant tissues are also described herein and methods for identifying plant cells, plant tissue and fertile plants having reduced expression of the transcription factor genes made using these methods are disclosed herein.

As used herein, "transgenic" refers to an organism in which a nucleic acid fragment containing a heterologous or "non-native" nucleotide sequence has been introduced. The genome inserts introduced into the plants are stable, inheritable and impart improved plant performance.

Transcription factor genes, including crop-specific transcription factor gene sequences in preferred crop species are also useful as targets for up regulation, alone or in combinations, to improve crop performance are described herein. Methods of upregulating these genes in these crops including site-specific nucleases, guide RNAs, guide RNA-DNA hybrids and guide DNAs, DNA constructs useful in the methods are described herein. Methods for introducing the site-specific nuclease and guide RNAs into plant cells and plant tissues are also described herein and methods for identifying plant cells, plant tissue and fertile plants having increased expression of the transcription factor genes made using these methods are disclosed herein. The genome inserts introduced into the plants are stable, inheritable and impart improved plant performance.

Additional methods for upregulating the transcription factor gene sequences in preferred crop species to improve crop performance including creation of transgenic, wherein a nucleic acid fragment containing a heterologous or non-native nucleotide sequence has been introduced. Cis-genic plants can also be created, wherein a nucleic acid fragment containing an endogenous or native nucleotide sequence has been introduced into the plant.

Methods of Plant Transformation

Known transformations methods can be used to upregulate or downregulate one or more gene sequences of the invention using transgenic, cis-genic or genome editing methods.

Vectors

Several plant transformation vector options are available, including those described in Gene Transfer to Plants, 1995, Potrykus et al., eds., Springer-Verlag Berlin Heidelberg New York, *Transgenic Plants: A Production System for Industrial and Pharmaceutical Proteins*, 1996, Owen et al., eds., John Wiley & Sons Ltd. Eng, and *Methods in Plant Molecular Biology: A Laboratory Course Manual*, 1995, Maliga et al., eds., Cold Spring Laboratory Press, New York. Plant transformation vectors generally include one or more coding sequences of interest under the transcriptional control of 5' and 3' regulatory sequences, including a promoter, a transcription termination and/or polyadenylation signal, and a selectable or screenable marker gene.

Many vectors are available for transformation using *Agrobacterium tumefaciens*. These typically carry at least one T-DNA sequence and include vectors such as pBIN19. Typical vectors suitable for *Agrobacterium* transformation include the binary vectors pCIB200 and pCIB2001, as well as the binary vector pCIB 10 and hygromycin selection derivatives thereof. (See, for example, U.S. Pat. No. 5,639, 949).

Transformation without the use of *Agrobacterium tumefaciens* circumvents the requirement for T-DNA sequences in the chosen transformation vector and consequently vectors lacking these sequences are utilized in addition to vectors such as the ones described above which contain T-DNA sequences. The choice of vector for transformation techniques that do not rely on *Agrobacterium* depends largely on the preferred selection for the species being transformed. Typical vectors suitable for non-*Agrobacterium* transformation include pCIB3064, pSOG 19, and pSOG35. (See, for example, U.S. Pat. No. 5,639,949). Alternatively, DNA fragments containing the transgene and the necessary regulatory elements for expression of the transgene can be excised from a plasmid and delivered to the plant cell using microprojectile bombardment-mediated, or alternatively, nanotube-mediated methods.

Protocols

Transformation protocols as well as protocols for introducing nucleotide sequences into plants may vary depending on the type of plant or plant cell targeted for transformation. Suitable methods of introducing nucleotide sequences into plant cells and subsequent insertion into the plant genome include microinjection (Crossway et al. (1986) Biotechniques 4:320-334), electroporation (Riggs et al. (1986) *Proc. Natl. Acad. Sci. USA* 83:5602-5606), *Agrobacterium*-mediated transformation (Townsend et al., U.S. Pat. No. 5,563, 055; Zhao et al. WO US98/01268), direct gene transfer (Paszkowski et al. (1984) *EMBO J.* 3:2717-2722), and ballistic particle acceleration (see, for example, Sanford et al., U.S. Pat. No. 4,945,050; Tomes et al. (1995) *Plant Cell, Tissue, and Organ Culture: Fundamental Methods*, ed. Gamborg and Phillips (Springer-Verlag, Berlin); and McCabe et al. *Biotechnology* 6:923-926 (1988)). Also see Weissinger et al. *Ann. Rev. Genet.* 22:421-477 (1988); Sanford et al. Particulate Science and Technology 5:27-37 (1987) (onion); Christou et al. *Plant Physiol.* 87:671-674 (1988) (soybean); McCabe et al. (1988) BioTechnology 6:923-926 (soybean); Finer and McMullen *In Vitro Cell Dev. Biol.* 27P:175-182 (1991) (soybean); Singh et al. *Theor. Appl. Genet.* 96:319-324 (1998) (soybean); Dafta et al.

(1990) Biotechnology 8:736-740 (rice); Klein et al. Proc. Natl. Acad. Sci. USA 85:4305-4309 (1988) (maize); Klein et al. Biotechnology 6:559-563 (1988) (maize); Tomes, U.S. Pat. No. 5,240,855; Buising et al., U.S. Pat. Nos. 5,322,783 and 5,324,646; Tomes et al. (1995) in Plant Cell, Tissue, and Organ Culture: Fundamental Methods, ed. Gamborg (Springer-Verlag, Berlin) (maize); Klein et al. Plant Physiol. 91:440-444 (1988) (maize); Fromm et al. Biotechnology 8:833-839 (1990) (maize); Hooykaas-Van Slogteren et al. Nature 311:763-764 (1984); Bowen et al., U.S. Pat. No. 5,736,369 (cereals); Bytebier et al. Proc. Natl. Acad. Sci. USA 84:5345-5349 (1987) (Liliaceae); De Wet et al. in The Experimental Manipulation of Ovule Tissues, ed. Chapman et al. (Longman, N.Y.), pp. 197-209 (1985) (pollen); Kaeppler et al. Plant Cell Reports 9:415-418 (1990) and Kaeppler et al. Theor. Appl. Genet. 84:560-566 (1992) (whisker-mediated transformation); D'Halluin et al. Plant Cell 4:1495-1505 (1992) (electroporation); Li et al. Plant Cell Reports 12:250-255 (1993) and Christou and Ford Annals of Botany 75:407-413 (1995) (rice); Osjoda et al. Nature Biotechnology 14:745-750 (1996) (maize via Agrobacterium tumefaciens). References for protoplast transformation and/or gene gun for Agrisoma technology are described in WO 2010/037209. Methods for transforming plant protoplasts are available including transformation using polyethylene glycol (PEG), electroporation, and calcium phosphate precipitation (see for example Potrykus et al., 1985, Mol. Gen. Genet., 199, 183-188; Potrykus et al., 1985, Plant Molecular Biology Reporter, 3, 117-128). Methods for plant regeneration from protoplasts have also been described [Evans et al., in Handbook of Plant Cell Culture, Vol 1, (Macmillan Publishing Co., New York, 1983); Vasil, I K in Cell Culture and Somatic Cell Genetics (Academic, Oro, 1984)].

Transformation protocols as well as protocols for introducing nucleotide sequences into plants may vary depending on the type of plant or plant cell, i.e., monocot or dicot, targeted for transformation.

Suitable methods of introducing nucleotide sequences into plant cells and subsequent insertion into the plant genome are described in US 2010/0229256 A1 to Somleva & Ali and US 2012/0060413 to Somleva et al.

The transformed cells are grown into plants in accordance with conventional techniques. See, for example, McCormick et al., 1986, Plant Cell Rep. 5: 81-84. These plants may then be grown, and either pollinated with the same transformed variety or different varieties, and the resulting hybrid having constitutive expression of the desired phenotypic characteristic identified. Two or more generations may be grown to ensure that constitutive expression of the desired phenotypic characteristic is stably maintained and inherited and then seeds harvested to ensure constitutive expression of the desired phenotypic characteristic has been achieved.

Procedures for in planta transformation can be simple. Tissue culture manipulations and possible somaclonal variations are avoided and only a short time is required to obtain transgenic plants. However, the frequency of transformants in the progeny of such inoculated plants is relatively low and variable. At present, there are very few species that can be routinely transformed in the absence of a tissue culture-based regeneration system. Stable *Arabidopsis* transformants can be obtained by several in planta methods including vacuum infiltration (Clough & Bent, 1998, *The Plant J.* 16: 735-743), transformation of germinating seeds (Feldmann & Marks, 1987, *Mol. Gen. Genet.* 208: 1-9), floral dip (Clough and Bent, 1998, *Plant J.* 16: 735-743), and floral spray (Chung et al., 2000, *Transgenic Res.* 9: 471-476). Other plants that have successfully been transformed by in planta methods include rapeseed and radish (vacuum infiltration, Ian and Hong, 2001, *Transgenic Res.*, 10: 363-371; Desfeux et al., 2000, *Plant Physiol.* 123: 895-904), *Medicago truncatula* (vacuum infiltration, Trieu et al., 2000, *Plant J.* 22: 531-541), camelina (floral dip, WO/2009/117555 to Nguyen et al.), and wheat (floral dip, Zale et al., 2009, *Plant Cell Rep.* 28: 903-913). In planta methods have also been used for transformation of germ cells in maize (pollen, Wang et al. 2001, *Acta Botanica Sin.*, 43, 275-279; Zhang et al., 2005, *Euphytica*, 144, 11-22; pistils, Chumakov et al. 2006, *Russian J. Genetics*, 42, 893-897; Mamontova et al. 2010, *Russian J. Genetics*, 46, 501-504) and Sorghum (pollen, Wang et al. 2007, *Biotechnol. Appl. Biochem.*, 48, 79-83).

Selection

Following transformation by any one of the methods described above, the following procedures can be used to obtain a transformed plant expressing the transgenes: select the plant cells that have been transformed on a selective medium; regenerate the plant cells that have been transformed to produce differentiated plants; select transformed plants expressing the DNA construct for introducing the targeted insertion of the DNA sequence elements producing the desired level of desired polypeptide(s) in the desired tissue and cellular location.

The cells that have been transformed may be grown into plants in accordance with conventional techniques. See, for example, McCormick et al. *Plant Cell Reports* 5:81-84 (1986). These plants may then be grown, and either pollinated with the same transformed variety or different varieties, and the resulting hybrid having constitutive expression of the desired phenotypic characteristic identified. Two or more generations may be grown to ensure that constitutive expression of the desired phenotypic characteristic is stably maintained and inherited and then seeds harvested to ensure constitutive expression of the desired phenotypic characteristic has been achieved.

Transgenic plants can be produced using conventional techniques to express any genes of interest in plants or plant cells (*Methods in Molecular Biology*, 2005, vol. 286, Transgenic Plants: Methods and Protocols, Pena L., ed., Humana Press, Inc. Totowa, NJ; Shyamkumar Barampuram and Zhanyuan J. Zhang, Recent Advances in Plant Transformation, in James A. Birchler (ed.), *Plant Chromosome Engineering: Methods and Protocols*, Methods in Molecular Biology, vol. 701, Springer Science+Business Media). Typically, gene transfer, or transformation, is carried out using explants capable of regeneration to produce complete, fertile plants. Generally, a DNA or an RNA molecule to be introduced into the organism is part of a transformation vector. A large number of such vector systems known in the art may be used, such as plasmids. The components of the expression system can be modified, e.g., to increase expression of the introduced nucleic acids. For example, truncated sequences, nucleotide substitutions or other modifications may be employed. Expression systems known in the art may be used to transform virtually any plant cell under suitable conditions. A transgene comprising a DNA molecule encoding a gene of interest is preferably stably transformed and integrated into the genome of the host cells. Transformed cells are preferably regenerated into whole fertile plants. Detailed description of transformation techniques are within the knowledge of those skilled in the art.

Plant promoters can be selected to control the expression of the transgene in different plant tissues or organelles for all of which methods are known to those skilled in the art (Gasser & Fraley, 1989, *Science* 244: 1293-1299). In one embodiment, promoters are selected from those of eukaryotic or synthetic origin that are known to yield high levels of expression in plants and algae. In a preferred embodiment, promoters are selected from those that are known to provide high levels of expression in monocots. Specific exemplary promoters useful for expression of genes in dicots and monocots are provided in TABLE 1 and TABLE 2, respectively.

TABLE 1

Promoters useful for expression of genes in dicots.

| Gene/Promoter | Expression | Native organism of promoter | Gene ID* (SEQ ID NO) |
|---|---|---|---|
| CaMV 35S | Constitutive | Cauliflower mosaic virus | (SEQ ID NO: 206) |
| Hsp70 | Constitutive | *Glycine max* | Glyma.02G093200 (SEQ ID NO: 207) |
| Chlorophyll A/B Binding Protein (Cab5) | Constitutive | *Glycine max* | Glyma.08G082900 (SEQ ID NO: 208) |
| Pyruvate phosphate dikinase (PPDK) | Constitutive | *Glycine max* | Glyma.06G252400 (SEQ ID NO: 209) |
| Actin | Constitutive | *Glycine max* | Glyma.19G147900 (SEQ ID NO: 210) |
| ADP-glucose pyrophosphorylase (AGPase) | Seed-specific | *Glycine max* | Glyma.04G011900 (SEQ ID NO: 211) |
| Glutelin C (GluC) | Seed-specific | *Glycine max* | Glyma.03G163500 (SEQ ID NO: 212) |
| β-fructofuranosidase insoluble isoenzyme 1 (CIN1) | Seed-specific | *Glycine max* | Glyma.17G227800 (SEQ ID NO: 213) |
| MADS-Box | Cob-specific | *Glycine max* | Glyma.04G257100 (SEQ ID NO: 214) |
| Glycinin (subunit G1) | Seed-specific | *Glycine max* | Glyma.03G163500 (SEQ ID NO: 215) |
| oleosin isoform A | Seed-specific | *Glycine max* | Glyma.16G071800 (SEQ ID NO: 216) |
| Hsp70 | Constitutive | *Brassica napus* | BnaA09g05860D |
| Chlorophyll A/B Binding Protein (Cab5) | Constitutive | *Brassica napus* | BnaA04g20150D |
| Pyruvate phosphate dikinase (PPDK) | Constitutive | *Brassica napus* | BnaA01g18440D |
| Actin | Constitutive | *Brassica napus* | BnaA03g34950D |
| ADP-glucose pyrophosphorylase (AGPase) | Seed-specific | *Brassica napus* | BnaA06g40730D |
| Glutelin C (GluC) | Seed-specific | *Brassica napus* | BnaA09g50780D |
| β-fructofuranosidase insoluble isoenzyme 1 (CIN1) | Seed-specific | *Brassica napus* | BnaA04g05320D |
| MADS-Box | Cob-specific | *Brassica napus* | BnaA05g02990D |
| Glycinin (subunit G1) | Seed-specific | *Brassica napus* | BnaA01g08350D |
| oleosin isoform A | Seed-specific | *Brassica napus* | BnaC06g12930D |
| 1.7S napin (napA) | Seed-specific | *Brassica napus* | BnaA01g17200D |

*Gene ID includes sequence information for coding regions as well as associated promoters. 5' UTRs, and 3' UTRs and are available at Phytozome (see JGI website phytozome.jgi.doe.gov/pz/portal.html).

TABLE 2

Promoters useful for expression of genes in monocots, including maize and rice.

| Gene/Promoter | Expression | Rice* | Maize* | Other |
|---|---|---|---|---|
| Hsp70 | Constitutive | LOC_Os05g38530 (SEQ ID NO: 217) | GRMZM2G310431 (SEQ ID NO: 225) | |
| Chlorophyll A/B Binding Protein (Cab5) | Constitutive | LOC_Os01g41710 (SEQ ID NO: 218) | AC207722.2_FG009 (SEQ ID NO: 226) GRMZM2G351977 (SEQ ID NO: 227) | |
| maize ubiquitin promoter/maize ubiquitin intron (sequence listed in Genbank KT962835) | Constitutive | | (SEQ ID NO: 228) | |

TABLE 2-continued

Promoters useful for expression of genes in monocots, including maize and rice.

| Gene/Promoter | Expression | Rice* | Maize* | Other |
|---|---|---|---|---|
| maize ubiquitin promoter/maize ubiquitin intron (maize promoter and intron sequence with 99% identity to sequence in Genbank KT985051.1) | Constitutive | | (SEQ ID NO: 229) | |
| CaMV 35S | Constitutive | — | — | Cauliflower mosaic virus (SEQ ID NO: 206) |
| Pyruvate phosphate dikinase (PPDK) | Constitutive | LOC_Os05g33570 (SEQIDNO: 219) | GRMZM2G306345 (SEQ ID NO: 230) | |
| Actin | Constitutive | LOC_Os03g50885 (SEQ ID NO: 220) | GRMZM2G047055 (SEQ ID NO: 231) | |
| Hybrid cab5/hsp70 intron promoter | Constitutive | N/A | SEQ ID NO: 232 | |
| ADP-glucose pyrophos-phorylase (AGPase) | Seed-specific | LOC_Os01g44220 (SEQ ID NO: 221) | GRMZM2G429899 (SEQ ID NO: 233) | |
| Glutelin C (GluC) | Seed-specific | LOC_Os02g25640 (SEQ ID NO: 222) | N/A | |
| β-fructofuranosidase insoluble isoenzyme 1 (CIN1) | Seed-specific | LOC_Os02g33110 (SEQ ID NO: 223) | GRMZM2G139300 (SEQ ID NO: 234) | |
| MADS-Box | Cob-specific | LOC_Os12g10540 (SEQ ID NO: 224) | GRMZM2G160687 (SEQ ID NO: 235) | |
| Maize TrpA promoter | Seed-specific | | GRMZM5G841619 (SEQ ID NO: 236) | |

*Gene ID includes sequence information for coding regions as well as associated promoters, 5' UTRs, and 3' UTRs and are available at Phytozome (see JGI website phytozome.jgi.doe.gov/pz/portal.html).

Constitutive promoters include, for example, the core promoter of the Rsyn7 promoter and other constitutive promoters disclosed in WO 99/43838 and U.S. Pat. No. 6,072,050, the core CaMV 35S promoter (Odell et al., 1985, *Nature* 313: 810-812), rice actin (McElroy et al., 1990, *Plant Cell* 2: 163-171), ubiquitin (Christensen et al., 1989, *Plant Mol. Biol.* 12: 619-632; Christensen et al., 1992, *Plant Mol. Biol.* 18: 675-689), pEMIU (Last et al., 1991, *Theor. Appl. Genet.* 81: 581-588), MAS (Velten et al., 1984, *EMBO J* 3: 2723-2730), and ALS promoter (U.S. Pat. No. 5,659,026). Other constitutive promoters are described in U.S. Pat. Nos. 5,608,149; 5,608,144; 5,604,121; 5,569,597; 5,466,785; 5,399,680; 5,268,463; and 5,608,142.

"Tissue-preferred" promoters can be used to target gene expression within a particular tissue. Compared to chemically inducible systems, developmentally and spatially regulated stimuli are less dependent on penetration of external factors into plant cells. Tissue-preferred promoters include those described by Van Ex et al., 2009, *Plant Cell Rep.* 28: 1509-1520; Yamamoto et al., 1997, *Plant J.* 12: 255-265; Kawamata et al., 1997, *Plant Cell Physiol.* 38: 792-803; Hansen et al., 1997, *Mol. Gen. Genet.* 254: 337-343; Russell et al., 1997, *Transgenic Res.* 6: 157-168; Rinehart et al., 1996, *Plant Physiol.* 112: 1331-1341; Van Camp et al., 1996, *Plant Physiol.* 112: 525-535; Canevascini et al., 1996, *Plant Physiol.* 112: 513-524; Yamamoto et al., 1994, *Plant Cell Physiol.* 35: 773-778; Lam, 1994, *Results Probl. Cell Differ.* 20: 181-196, Orozco et al., 1993, *Plant Mol. Biol.* 23: 1129-1138; Matsuoka et al., 1993, *Proc. Natl. Acad. Sci. USA* 90: 9586-9590, and Guevara-Garcia et al., 1993, *Plant J.* 4: 495-505. Such promoters can be modified, if necessary, for weak expression.

Any of the described promoters can be used to control the expression of one or more of the genes of the invention, their homologs and/or orthologs as well as any other genes of interest in a defined spatiotemporal manner.

Expression Cassettes

Nucleic acid sequences intended for expression in transgenic plants are first assembled in expression cassettes behind a suitable promoter active in plants. The expression cassettes may also include any further sequences required or selected for the expression of the transgene. Such sequences include, but are not restricted to, transcription terminators, extraneous sequences to enhance expression such as introns, vital sequences, and sequences intended for the targeting of the gene product to specific organelles and cell compartments. These expression cassettes can then be transferred to the plant transformation vectors described infra.

A variety of transcriptional terminators are available for use in expression cassettes. These are responsible for the termination of transcription beyond the transgene and the correct polyadenylation of the transcripts. Appropriate transcriptional terminators are those that are known to function in plants and include the CaMV 35S terminator, the tml terminator, the nopaline synthase terminator and the pea rbcS E9 terminator. These are used in both monocotyledonous and dicotyledonous plants.

Individual plants within a population of transgenic plants that express a recombinant gene(s) may have different levels of gene expression. The variable gene expression is due to multiple factors including multiple copies of the recombinant gene, chromatin effects, and gene suppression. Accordingly, a phenotype of the transgenic plant may be measured as a percentage of individual plants within a population. The yield of a plant can be measured simply by weighing. The yield of seed from a plant can also be determined by weighing. The increase in seed weight from a plant can be due to a number of factors, an increase in the number or size of the seed pods, an increase in the number of seed or an increase in the number of seed per plant. In the laboratory or greenhouse seed yield is usually reported as the weight of seed produced per plant and in a commercial crop production setting yield is usually expressed as weight per acre or weight per hectare.

A recombinant DNA construct including a plant-expressible gene or other DNA of interest is inserted into the genome of a plant by a suitable method. Suitable methods include, for example, *Agrobacterium tumefaciens*-mediated DNA transfer, direct DNA transfer, liposome-mediated DNA transfer, electroporation, co-cultivation, diffusion, particle bombardment, microinjection, gene gun, calcium phosphate coprecipitation, viral vectors, and other techniques. Suitable plant transformation vectors include those derived from a Ti plasmid of *Agrobacterium tumefaciens*. In addition to plant transformation vectors derived from the Ti or root-inducing (Ri) plasmids of *Agrobacterium*, alternative methods can be used to insert DNA constructs into plant cells. A transgenic plant can be produced by selection of transformed seeds or by selection of transformed plant cells and subsequent regeneration.

In one embodiment, the transgenic plants are grown (e.g., on soil) and harvested. In one embodiment, above ground tissue is harvested separately from below ground tissue. Suitable above ground tissues include shoots, stems, leaves, flowers, grain, and seed. Exemplary below ground tissues include roots and root hairs. In one embodiment, whole plants are harvested and the above ground tissue is subsequently separated from the below ground tissue.

Genetic constructs may encode a selectable marker to enable selection of transformation events. There are many methods that have been described for the selection of transformed plants [for review see (Miki et al., *Journal of Biotechnology*, 2004, 107, 193-232) and references incorporated within]. Selectable marker genes that have been used extensively in plants include the neomycin phosphotransferase gene nptII (U.S. Pat. Nos. 5,034,322, 5,530,196), hygromycin resistance gene (U.S. Pat. No. 5,668,298, Waldron et al., (1985), *Plant Mol Biol*, 5:103-108; Zhijian et al., (1995), *Plant Sci*, 108:219-227), the bar gene encoding resistance to phosphinothricin (U.S. Pat. No. 5,276,268), the expression of aminoglycoside 3"-adenyltransferase (aadA) to confer spectinomycin resistance (U.S. Pat. No. 5,073,675), the use of inhibition resistant 5-enolpyruvyl-3-phoshikimate synthetase (U.S. Pat. No. 4,535,060) and methods for producing glyphosate tolerant plants (U.S. Pat. Nos. 5,463,175; 7,045,684). Other suitable selectable markers include, but are not limited to, genes encoding resistance to chloramphenicol (Herrera Estrella et al., (1983), *EMBO J*, 2:987-992), methotrexate (Herrera Estrella et al., (1983), *Nature*, 303:209-213; Meijer et al, (1991), *Plant Mol Biol*, 16:807-820); streptomycin (Jones et al., (1987), *Mol Gen Genet*, 210:86-91); bleomycin (Hille et al., (1990), *Plant Mol Biol*, 7:171-176); sulfonamide (Guerineau et al., (1990), *Plant Mol Biol*, 15:127-136); bromoxynil (Stalker et al., (1988), *Science*, 242:419-423); glyphosate (Shaw et al., (1986), *Science*, 233:478-481); phosphinothricin (DeBlock et al., (1987), *EMBO J*, 6:2513-2518).

Methods of plant selection that do not use antibiotics or herbicides as a selective agent have been previously described and include expression of glucosamine-6-phosphate deaminase to inactive glucosamine in plant selection medium (U.S. Pat. No. 6,444,878) and a positive/negative system that utilizes D-amino acids (Erikson et al., *Nat Biotechnol*, 2004, 22, 455-8). European Patent Publication No. EP 0 530 129 A1 describes a positive selection system which enables the transformed plants to outgrow the non-transformed lines by expressing a transgene encoding an enzyme that activates an inactive compound added to the growth media. U.S. Pat. No. 5,767,378 describes the use of mannose or xylose for the positive selection of transgenic plants.

Methods for positive selection using sorbitol dehydrogenase to convert sorbitol to fructose for plant growth have also been described (WO 2010/102293). Screenable marker genes include the beta-glucuronidase gene (Jefferson et al., 1987, *EMBO J.* 6: 3901-3907; U.S. Pat. No. 5,268,463) and native or modified green fluorescent protein gene (Cubitt et al., 1995, *Trends Biochem. Sci.* 20: 448-455; Pan et al., 1996, *Plant Physiol.* 112: 893-900).

Transformation events can also be selected through visualization of fluorescent proteins such as the fluorescent proteins from the nonbioluminescent Anthozoa species which include DsRed, a red fluorescent protein from the *Discosoma* genus of coral (Matz et al. (1999), Nat Biotechnol 17: 969-73). An improved version of the DsRed protein has been developed (Bevis and Glick (2002), *Nat Biotech* 20: 83-87) for reducing aggregation of the protein.

Visual selection can also be performed with the yellow fluorescent proteins (YFP) including the variant with accelerated maturation of the signal (Nagai, T. et al. (2002), Nat Biotech 20: 87-90), the blue fluorescent protein, the cyan fluorescent protein, and the green fluorescent protein (Sheen et al. (1995), Plant J 8: 777-84; Davis and Vierstra (1998), *Plant Molecular Biology* 36: 521-528). A summary of fluorescent proteins can be found in Tzfira et al. (Tzfira et al. (2005), Plant Molecular Biology 57: 503-516) and Verkhusha and Lukyanov (Verkhusha, V. V. and K. A. Lukyanov (2004), Nat Biotech 22: 289-296) whose references are incorporated in entirety. Improved versions of many of the fluorescent proteins have been made for various applications. It will be apparent to those skilled in the art how to use the improved versions of these proteins or combinations of these proteins for selection of transformants.

The plants modified for enhanced performance by reducing the expression of the transcription factor genes or transcription factor gene combinations may be combined or stacked with input traits by crossing or plant breeding. Useful input traits include herbicide resistance and insect tolerance, for example a plant that is tolerant to the herbicide glyphosate and that produces the *Bacillus thuringiensis* (BT) toxin. Glyphosate is a herbicide that prevents the production of aromatic amino acids in plants by inhibiting the enzyme 5-enolpyruvylshikimate-3-phosphate synthase (EPSP synthase). The overexpression of EPSP synthase in a crop of interest allows the application of glyphosate as a weed killer without killing the modified plant (Suh, et al., J. M Plant Mol. Biol. 1993, 22, 195-205). BT toxin is a protein that is lethal to many insects providing the plant that produces it protection against pests (Barton, et al. Plant Physiol. 1987, 85, 1103-1109). Other useful herbicide tolerance traits include but are not limited to tolerance to Dicamba by expression of the dicamba monoxygenase gene (Behrens et al, 2007, Science, 316, 1185), tolerance to 2,4-D and 2,4-D choline by expression of a bacterial aad-1 gene that encodes for an aryloxyalkanoate dioxygenase enzyme (Wright et al., Proceedings of the National Academy of Sciences, 2010, 107, 20240), glufosinate tolerance by expression of the bialophos resistance gene (bar) or the pat gene encoding the enzyme phosphinotricin acetyl transferase (Droge et al., Planta, 1992, 187, 142), as well as genes encoding a modified 4-hydroxyphenylpyruvate dioxygenase (HPPD) that provides tolerance to the herbicides mesotrione, isoxaflutole, and tembotrione (Siehl et al., Plant Physiol, 2014, 166, 1162). The plants modified for enhanced yield by reducing the expression of the transcription factor genes or transcription factor gene combinations may be combined or stacked with other genes which improve plant performance.

Transcriptome-based gene regulatory association networks can be used to identify transcription factors associated with a trait (Skraly et al., 2018, Plant Science, 273, 23-32). These networks can be generated using expression data obtained from RNA sequencing (RNA-SEQ) or microarray analysis of plants. Large-scale data sets from plants grown under a variety of conditions are available for some plants from public databases and are useful for creating these co-expression networks to probe the transcriptional organization of a particular plant and to identify key transcription factors that control a trait. In oilseed crops such as canola or *Camelina*, increasing seed yield and/or oil content are key traits that can significantly impact the economics of the crop. It was thus the object of this work to create co-expression networks using *Camelina* gene expression data to identify genes to increase seed yield and/or oil content. The *Camelina* specific genes identified in this work can be used to increase the value of *Camelina* as a crop, and can also be used to identify orthologs in other oilseed crops, such as corn, canola, and soybean, for increasing seed yield and/or oil content.

EXAMPLES

Example 1. Expression Data Retrieval and Processing

Previously deposited *Camelina* gene expression datasets encompassing 162 RNA-sequencing libraries from the NCBI sequence read archive (website: //www.ncbi.nlm.nih-.gov/sra/docs/sradownload/) were identified. Six different *Camelina* varieties (Suneson, DH55, CO-46, Joelle, Celine and MT-5) associated with thirteen different tissue types were represented.

Gene expression data, especially when collected across different experiments from different laboratories, needs to be normalized to remove potential biases introduced by various Next-generation sequencing platforms. Basic quality control was performed and ribosomal RNA (rRNA) sequences were removed by using SilvaDB. Tools like FastQC (website: //www.bioinformatics.babraham.ac.uk/projects/fastqc/) and Cutadapt (website: //journal.embnet.org/index.php/embnetjournal/article/view/200) were used to check the quality of RNA-seq data, with a modular set of analyses to identify any issues associated with the sequencing data and to remove the adapters. Reads were mapped using HISAT2 (Pertea et al., 2016, Nat. Protoc., 11, 1650), an alignment program for mapping reads to the reference genome, and the alignments were assembled into transcripts. The counts per transcript were normalized and basic quality control information leveraging the alignments was produced. Finally, the normalized FPKM values (Fragment Per Kilobase of exon per Million fragments mapped) were transformed into a log 2 (1+FPKM) to minimize the noise associated with the low expression values. Wherever replicate information was available for RNA-seq libraries, the replicate's expression values were averaged. This resulted in a final set of 88 samples.

There are several tools available to build co-expression networks. For this work an R program based package called WGCNA (weighted gene co-expression network analysis) (Zhang and Horvath, 2005, Statistical Applications in Genetics and Molecular Biology 4:1, Article 17), was selected. The first step in generating a gene co-expression network is to perform a pair-wise comparison of gene expressions across all the samples by using simple Pearson correlation coefficients. The second step is to raise the correlation matrix to a power of beta (β) function to develop an adjacency matrix. This generates a square matrix in which each row and column represents one gene, so that an adjacency value $a_{ij}$ defines the "connectedness" of the two genes labeled i and j to each other. The Pearson correlation value $cor_{ij}$ defines the correlation of two genes labeled i and j based on the relationship between their normalized expression profiles. We used normalized read count data from the set of 88 samples described above, and the R package WGCNA was used to generate an unsigned connectivity matrix of the most-variable genes, yielding a 17,804×17,804 matrix. Each of the values within the matrix was raised to the power of β=6 to give better scale-free topology of the network (Zhang and Horvath, 2005, Statistical Applications in Genetics and Molecular Biology 4:1, Article 17).

Example 2. Identification of Co-Expression Modules

The R package WGCNA was used to find co-expression modules (groups of genes that show similar expression patterns across multiple samples or conditions) using the correlation and adjacency matrices described in Example 1. "Guilt-by-association" principles (Wolfe et al., 2005, BMC Bioinf., 6, 227) assume that genes with similar expression patterns are likely to be functionally associated and may participate in the same or similar functions. The modules were identified based on hierarchical clustering yielding groups of genes with high topological overlap. Twenty-one modules were identified and these modules contained between 35 and 6637 genes, depending on the module (TABLE 3). The known transcription factors and acyl lipid related genes were identified within these co-expression modules. The number of total genes in each module, along with the number of TFs and acyl lipid related genes, are shown in TABLE 3. Each module has been assigned a color, as is typically done within the WGCNA programs, for identification purposes.

TABLE 3

Summary of the co-expression modules identified through WGCNA using *Camelina sativa* transcriptome data

| Module | Module Color | Number of genes within module | TF genes within module | Acyl lipid related genes within module |
|---|---|---|---|---|
| 1 | turquoise | 6637 | 644 | 262 |
| 2 | blue | 4174 | 183 | 226 |
| 3 | brown | 2519 | 211 | 164 |
| 4 | yellow | 970 | 32 | 21 |
| 5 | green | 855 | 61 | 42 |
| 6 | red | 743 | 78 | 31 |
| 7 | black | 236 | 1 | 5 |
| 8 | pink | 209 | 10 | 7 |
| 9 | magenta | 169 | 15 | 10 |
| 10 | purple | 159 | 18 | 33 |
| 11 | green yellow | 156 | 6 | 5 |
| 12 | tan | 134 | 12 | 2 |
| 13 | salmon | 130 | 5 | 4 |
| 14 | cyan | 128 | 17 | |
| 15 | midnight blue | 118 | 13 | 6 |
| 16 | light cyan | 109 | 5 | 4 |
| 17 | grey60 | 102 | | 3 |
| 0 | grey | 79 | 3 | 3 |

TABLE 3-continued

Summary of the co-expression modules identified through WGCNA using *Camelina sativa* transcriptome data

| Module | Module Color | Number of genes within module | TF genes within module | Acyl lipid related genes within module |
|---|---|---|---|---|
| 18 | light green | 66 | 1 | 1 |
| 19 | light yellow | 39 |  | 2 |
| 20 | royal blue | 37 |  |  |
| 21 | dark red | 35 | 2 | 2 |
|  | Total | 17804 | 1317 | 833 |

Since co-expression modules often consist of a large number of genes, it is important to identify which gene(s) in each module are important for the traits of interest. A data mining workflow describing various steps involved in evaluation of the identified module(s) is shown in FIG. 1. Briefly, gene set enrichment analysis is performed on each co-expression module. This helps to identify what metabolic pathways or processes are most represented in the module. Gene Ontology (GO), the accepted standard in gene functionality description, is typically used for functional annotation of the genes and gene set enrichment analysis. For our purposes, publicly available web-based gene ontology (GO) analysis tools such as agriGO (website: //bioinfo.cau.edu.cn/agriGO/), panther (website: //www.pantherdb.org/) and blast2go (website: //www.blast2go.com) were used for the gene enrichment analysis step. TABLE 4 shows the enriched and/or overrepresented pathways that are potentially associated with seed oil content and/or seed yield traits in the modules generated with the *Camelina sativa* transcriptome data described in Example 1.

TABLE 4

Gene set enrichment analysis of co-expression modules[1]

| Module | Total # of genes in module | # of TFs | # of acyl lipid related genes | Enriched pathways or processes relevant to seed yield and seed oil content | |
|---|---|---|---|---|---|
|  |  |  |  | Biological process | # of genes |
| Turquoise | 6637 | 644 | 262 | Response to stress | 349 |
|  |  |  |  | Regulation of primary metabolic process | 255 |
|  |  |  |  | Nitrogen metabolic processes | 247 |
|  |  |  |  | Carbohydrate metabolic processes | 866 |
|  |  |  |  | Cellular processes | 1055 |
|  |  |  |  | Primary metabolic processes | 818 |
|  |  |  |  | Response to stimulus | 1041 |
|  |  |  |  | Response to hormone | 334 |
|  |  |  |  | Transport | 340 |
|  |  |  |  | Metabolic process | 1466 |
| Blue | 4174 | 183 | 226 | Photosynthesis | 144 |
|  |  |  |  | Photosynthetic ETS | 36 |
|  |  |  |  | Chlorophyll metabolic process | 33 |
|  |  |  |  | Lipid metabolic process | 127 |
|  |  |  |  | Response to hormone | 173 |
|  |  |  |  | Regulation of photosynthesis | 20 |
|  |  |  |  | Response to abiotic stress | 301 |
|  |  |  |  | Metabolic process | 929 |
|  |  |  |  | Response to abiotic stimulus | 306 |
|  |  |  |  | Fatty acid biosynthetic process | 24 |
| Brown | 2519 | 211 | 164 | Lipid metabolic processes | 86 |
|  |  |  |  | Fatty acid metabolic process | 29 |
|  |  |  |  | Seed development | 60 |
|  |  |  |  | Fatty acid biosynthetic process | 23 |
|  |  |  |  | Seed coat development | 12 |
|  |  |  |  | Lipid biosynthetic process | 47 |
|  |  |  |  | Seed maturation | 14 |
|  |  |  |  | Positive regulation of metabolic process | 45 |
|  |  |  |  | Lipid transport | 20 |
|  |  |  |  | Carbohydrate metabolic process | 73 |
| Green | 855 | 61 | 42 | Seed development | 33 |
|  |  |  |  | Response to lipid | 37 |
|  |  |  |  | Response to hormone | 53 |
|  |  |  |  | Post-embryonic development | 49 |
|  |  |  |  | Reproductive system development | 42 |
| Magenta | 169 | 15 | 10 | Metabolic process | 62 |
|  |  |  |  | carbohydrate metabolic process | 13 |
|  |  |  |  | secondary metabolic process | 8 |
|  |  |  |  | single-organism metabolic process | 35 |
| Red | 743 | 78 | 31 | response to stress | 98 |
|  |  |  |  | secondary metabolic process | 28 |
|  |  |  |  | defense response | 50 |
|  |  |  |  | catabolic process | 47 |
|  |  |  |  | metabolic process | 207 |
|  |  |  |  | response to osmotic stress | 22 |
|  |  |  |  | lipid transport | 9 |

TABLE 4-continued

Gene set enrichment analysis of co-expression modules[1]

| Module | Total # of genes in module | # of TFs | # of acyl lipid related genes | Biological process | # of genes |
|---|---|---|---|---|---|
| Purple | 159 | 18 | 33 | lipid metabolic process | 13 |
| | | | | phenylpropanoid metabolic process | 9 |
| | | | | secondary metabolic process | 9 |
| | | | | developmental process | 20 |
| | | | | anatomical structure development | 20 |
| Yellow | 970 | 32 | 21 | cell cycle | 77 |
| | | | | regulation of cell cycle | 36 |
| | | | | regulation of mitotic cell cycle | 14 |
| | | | | DNA metabolic process | 30 |
| | | | | cell proliferation | 14 |
| | | | | mitotic cell cycle process | 41 |

[1]Gene ontology analysis was performed using agriGO v2.0 (website://systemsbiology.cau.edu.cn/agriGOv2/index.php).
For each module, the top ten pathways that are predicted to influence seed oil content and seed yield traits are listed.

Figure 2:
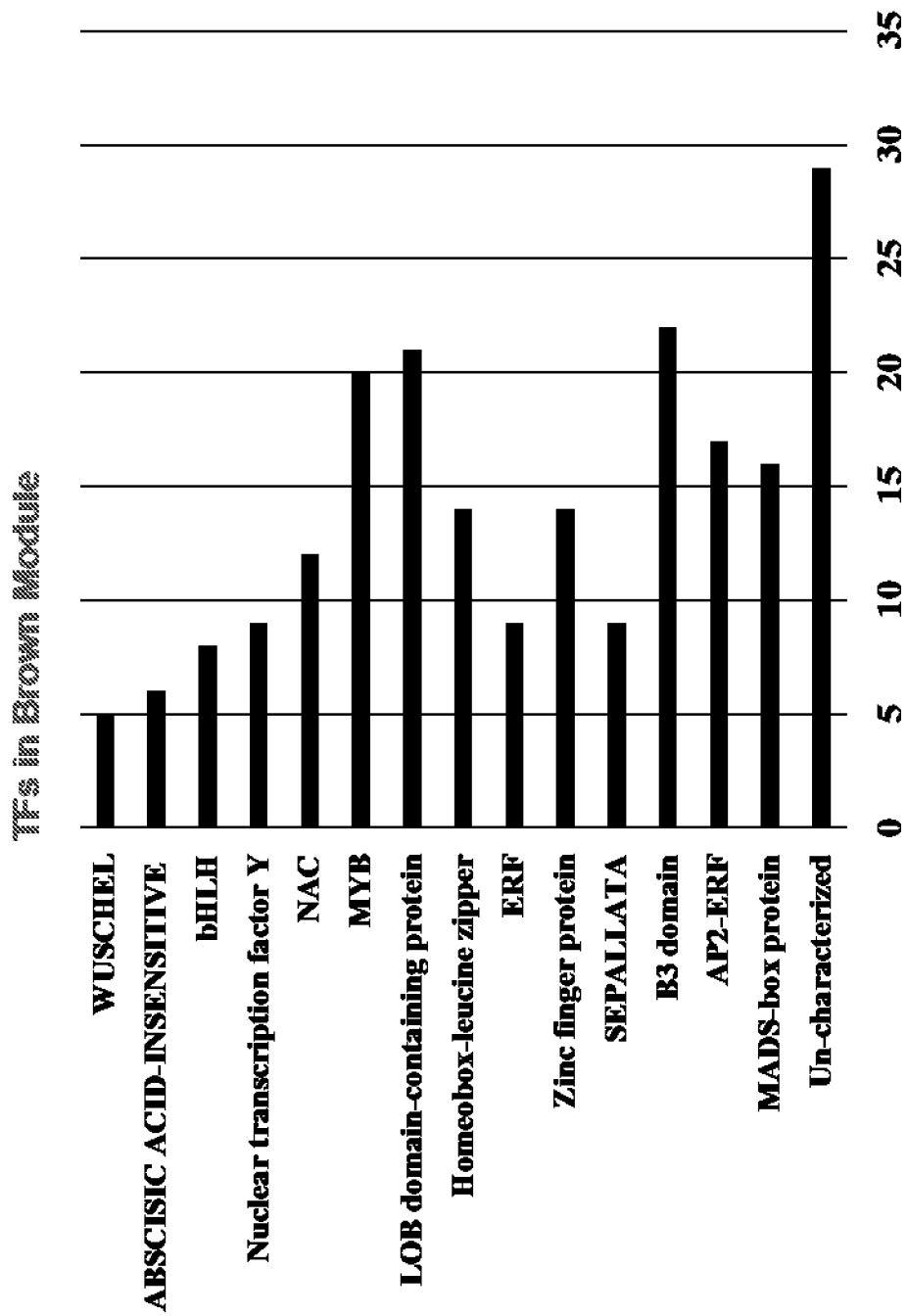
FIG. 2 illustrates a graph showing the total number of transcription factors and transcription factor families in the brown module.

Based on the functional enrichment analysis of most of the modules, the brown module (TABLE 4) appears to have the most important metabolic pathways that are potentially associated with seed oil content and seed yield. The brown module was thus chosen for further examination. The brown module contains 211 transcription factor genes that fall into 15 different families of plant-specific transcription factors (FIG. 2). Highly connected intra-modular hub genes were identified within the brown module based on the module membership (MM) of the genes, as previously described by Zhang and Horvath (2005). The MM is a value between −1 and +1 and represents a correlation of the expression value of each individual gene to the module eigengene (the module's eigengene is an expression value that is representative of the gene expression of the module). The MM measures each gene's strength within the module—the higher the value of MM, the stronger the hub gene's influence on the intra-modular network. The top 50 hub genes identified for the brown module are listed in TABLE 5.

TABLE 5

Top 50 hub genes identified within the brown module[1]

| Csa locus | kME brown | NCBI_ID | C. sativa description | A. thaliana ID | A. thaliana gene | A. thaliana description |
|---|---|---|---|---|---|---|
| Csa02g028180 SEQ ID NO: 14*** | 0.9458 | XP_010437974.1 | LOW QUALITY PROTEIN transcription factor TT8-like | AT4G09820 | TT8-like | basic helix-loop-helix (bHLH) DNA-binding superfamily protein(TT8) |
| Csa03g025850 SEQ ID NO: 58*** | 0.8996 | XP_010498656.1 | nuclear transcription factor Y subunit B-9-like isoform X1 | AT1G21970 | NYFB-9 | Nuclear transcription factor Y subunit B-9 |
| Csa03g031290 SEQ ID NO: 177 | 0.9744 | XP_010499297.1 | probable 2-oxoglutarate-dependent dioxygenase AOP1 | AT1G28030 | AOP1 | 2-oxoglutarate (2OG) and Fe(II)-dependent oxygenase superfamily protein |
| Csa03g031590 SEQ ID NO: 95** | 0.7889 | XP_010499344.1 | B3 domain-containing transcription factor LEC2-like isoform X1 | AT1G28300 | LEC2 | B3 domain-containing transcription factor LEC2 |
| Csa04g012470 SEQ ID NO: 178* | 0.8927 | XP_019100092.1 | B3 domain-containing transcription factor FUS3-like | AT3G26790 | FUS3 | AP2/B3-like transcriptional factor family protein(FUS3) |
| Csa04g015890 SEQ ID NO: 13*** | 0.9760 | XP_010502784.1 | transcription factor MYB46-like | AT3G27785 | MYB46 | myb domain protein 118(MYB118) |
| Csa04g024180 SEQ ID NO: 179 | 0.9258 | XP_019100162.1 | ABSCISIC ACID-INSENSITIVE 5-like protein 1 isoform X1 | AT3G44460 | ABI5 | Basic-leucine zipper (bZ1P) transcription factor family protein(DPBF2) |

TABLE 5-continued

Top 50 hub genes identified within the brown module[1]

| Csa locus | kME brown | NCBI_ID | C. sativa description | A. thaliana ID | A. thaliana gene | A. thaliana description |
|---|---|---|---|---|---|---|
| Csa04g038090 SEQ ID NO: 180 | 0.9820 | XP_010503963.1 | general transcription factor IIF subunit 2-like | AT3G52270 | TFIIF | Transcription initiation factor IIF, beta subunit |
| Csa04g040400 SEQ ID NO: 4** | 0.9080 | XP_010504232.1 | ethylene-responsive transcription factor WRI1-like isoform X1 | AT3G54320 | WRI1 | Integrase-type DNA-binding superfamily protein(WRI1) |
| Csa05g008730 SEQ ID NO: 11** | 0.9567 | XP_010506126.1 | agamous-like MADS-box protein AGL5 isoform X2 | AT2G42830 | AGL5 | K-box region and MADS-box transcription factor family protein(SHP2) |
| Csa05g035240 SEQ ID NO: 181 | 0.9780 | XP_019101013.1 | defensin-like protein 171 | AT2G29045 | AT2G29045 | Putative defensin-like protein 170 |
| Csa05g084910 SEQ ID NO: 182* | 0.9693 | XP_010511848.1 | LOB domain-containing protein 42-like | AT1G68510 | LOB | LOB domain-containing protein 42(LBD42) |
| Csa05g085820 SEQ ID NO: 92** | 0.7999 | XP_010511937.1 | floral homeotic protein APETALA 1 | AT1G69120 | APETALA1 | K-box region and MADS-box transcription factor family protein(AP1) |
| Csa06g006590 SEQ ID NO: 183 | 0.9156 | XP_010514343.1 | B3 domain-containing transcription factor FUS3-like isoform X1 | AT3G26790 | FUS3 | AP2/B3-like transcriptional factor family protein(FUS3) |
| Csa06g008890 SEQ ID NO: 8** | 0.9681 | XP_010514489.1 | transcription factor MYB98-like | AT3G27785 | MYB98 | myb domain protein 118(MYB118) |
| Csa06g017080 SEQ ID NO: 184* | 0.9183 | XP_019102243.1 | ABSCISIC ACID-INSENSITIVE 5-like protein 1 isoform X1 | AT3G44460 | ABI5 | Basic-leucine zipper (bZ1P) transcription factor family protein(DPBF2) |
| Csa06g028810 SEQ ID NO: 3*** | 0.9071 | XP_010515956.1 | ethylene-responsive transcription factor WRI1 isoform X2 | AT3G54320 | WRI1 | Integrase-type DNA-binding superfamily protein(WRI1) |
| Csa06g050920 SEQ ID NO: 200 | 0.9779 | XP_010518059.1 | dynamin-related protein 1D | AT2G44590 | AT2G44590 | DYNAMIN-like 1D(DL1D) |
| Csa07g034190 SEQ ID NO: 44*** | 0.9724 | XP_010415471.1 | LOB domain-containing protein 42 | AT1G68510 | LOB42 | LOB domain-containing protein 42(LBD42) |
| Csa07g057090 SEQ ID NO: 185 | 0.9827 | XP_010417391.1 | thermospermine synthase ACAULIS5-like | AT5G19530 | ACAULIS5 | S-adenosyl-L-methionine-dependent methyltransferases superfamily protein(ACL5) |
| Csa08g028460 SEQ ID NO: 186 | 0.9506 | XP_010455149.1 | acyl carrier protein 5, chloroplastic-like | AT5G27200 | ACP5 | acyl carrier protein 5(ACP5) |
| Csa08g037600 SEQ ID NO: 21** | 0.9128 | XP_010421888.1 | transcription factor TT8 | AT4G09820 | TT8-like | basic helix-loop-helix (bHLH) DNA-binding superfamily protein(TT8) |
| Csa09g011440 SEQ ID NO: 187 | 0.9356 | XP_019084789.1 | B3 domain-containing transcription factor FUS3-like | AT3G26790 | FUS3 | AP2/B3-like transcriptional factor family protein(FUS3) |
| Csa09g015930 SEQ ID NO: 16*** | 0.9814 | XP_010425555.1 | transcription factor MYB98-like | AT3G27785 | MYB98 | myb domain protein 118(MYB118) |
| Csa09g034290 SEQ ID NO: 188 | 0.9114 | XP_019085979.1 | ABSCISIC ACID-INSENSITIVE 5-like protein 1 isoform X2 | AT3G44460 | ABI5 | Basic-leucine zipper (bZ1P) transcription factor family protein(DPBF2) |

TABLE 5-continued

Top 50 hub genes identified within the brown module[1]

| Csa locus | kME brown | NCBI_ID | C. sativa description | A. thaliana ID | A. thaliana gene | A. thaliana description |
|---|---|---|---|---|---|---|
| Csa09g064030 SEQ ID NO: 1*** | 0.9217 | XP_010427125.1 | ethylene-responsive transcription factor WRI1 isoform X2 | AT3G54320 | WRI1 | Integrase-type DNA-binding superfamily protein(WRI1) |
| Csa10g022470 SEQ ID NO: 10*** | 0.9593 | XP_010449133.1 | dof zinc finger protein DOF4.4-like | AT4G21050 | DOF4.4 | Dof-type zinc finger domain-containing protein(DOF4.4) |
| Csa11g012280 SEQ ID NO: 189* | 0.9595 | XP_010445038.1 | ethylene-responsive transcription factor ERF015 | AT4G31060 | ERF015 | Integrase-type DNA-binding superfamily protein |
| Csa11g015010 SEQ ID NO: 190 | 0.9619 | XP_019086428.1 | O-acyltransferase WSD1-like | AT5G53380 | WSD1 | O-acyltransferase (WSD1-like) family protein |
| Csa11g064030 SEQ ID NO: 37*** | 0.9650 | XP_010441425.1 | nuclear transcription factor Y subunit B-6 isoform X2 | AT5G47670 | NYFB-6 | nuclear factor Y, subunit B6 (NF-YB6) |
| Csa12g003340 SEQ ID NO: 25*** | 0.9614 | XP_010446600.1 | dof zinc finger protein DOF4.7-like | AT4G38000 | DOF4.7 | DNA binding with one finger 4.7(DOF4.7) |
| Csa12g039190 SEQ ID NO: 191 | 0.9790 | XP_010449222.1 | UPF0725 protein At2g20620-like isoform X1 | AT2G20620 | At2g20620 | UPF0725 protein At2g20620 |
| Csa12g086590 SEQ ID NO: 192 | 0.9639 | XP_010450960.1 | non-specific lipid-transfer protein 2-like | AT5G38160 | AKCS9 | Bifunctional inhibitor/lipid-transfer protein/seed storage 2S albumin superfamily p |
| Csa13g020090 SEQ ID NO: 76** | 0.9540 | XP_010453918.1 | homeobox-leucine zipper protein HDG9-like | AT5G17320 | HDG9 | homeodomain GLABROUS 9(HDG9) |
| Csa13g027370 SEQ ID NO: 193 | 0.9754 | XP_010493379.1 | GDSL esterase/lipase At5g22810 | AT5G22810 | GDSL | GDSL-like lipase/acylhydrolase superfamily protein |
| Csa13g030540 SEQ ID NO: 194 | 0.9757 | XP_019090093.1 | uncharacterized protein LOC104738156, partial | AT5G24790 | AT5G24790 | transmembrane protein, putative (Protein of unknown function, DUF599) |
| Csa13g044750 SEQ ID NO: | 0.9334 | XP_010455373.1 | transcription factor TT8-like | AT4G09820 | TT8-like | basic helix-loop-helix (bHLH) DNA-binding superfamily protein(TT8) |
| Csa14g027200 SEQ ID NO: 46** | 0.9166 | XP_010459921.1 | nuclear transcription factor Y subunit B-9 isoform X1 | AT1G21970 | NYFB-9 | Nuclear transcription factor Y subunit B-10 |
| Csa14g041570 SEQ ID NO: 80** | 0.9501 | XP_010460983.1 | agamous-like MADS-box protein AGL86 | AT1G31640 | AGL86 | Agamous-like MADS-box protein AGL92 |
| Csa15g023010 SEQ ID NO: 195 | 0.9649 | XP_019097440.1 | uncharacterized protein LOC109131201 | AT3G16970 | S-protein | Plant self-incompatibility protein S1 family |
| Csa15g050420 SEQ ID NO: 196 | 0.8508 | XP_010466887.1 | B3 domain-containing transcription factor ABI3-like | AT3G24650 | ABI3 | late embryogenesis abundant protein, group 2 |
| Csa16g028530 SEQ ID NO: 27*** | 0.9746 | XP_010470800.1 | LOB domain-containing protein 42-like | AT1G68510 | LOB42 | LOB domain-containing protein 42(LBD42) |
| Csa17g028800 SEQ ID NO: 42*** | 0.9167 | XP_010477449.1 | nuclear transcription factor Y subunit B-9-like isoform X1 | AT1G21970 | NYFB-9 | Nuclear transcription factor Y subunit B-11 |
| Csa18g021260 SEQ ID NO: 82** | 0.9543 | XP_010482362.1 | nuclear transcription factor Y subunit C-6-like | AT5G50480 | NYFC-6 | nuclear factor Y, subunit C6 (NF-YC6) |

TABLE 5-continued

Top 50 hub genes identified within the brown module[1]

| Csa locus | kME brown | NCBI_ID | C. sativa description | A. thaliana ID | A. thaliana gene | A. thaliana description |
|---|---|---|---|---|---|---|
| Csa19g036570 SEQ ID NO: 197 | 0.9797 | XP_019096638.1 | uncharacterized protein LOC109130945 | AT3G24600 | AT3G24600 | late embryogenesis abundant protein, group 2 |
| Csa19g036630 SEQ ID NO: 198 | 0.8556 | XP_010488574.1 | B3 domain-containing transcription factor ABI3-like | AT3G24650 | ABI3 | late embryogenesis abundant protein, group 2 |
| Csa20g009570 SEQ ID NO: 19*** | 0.9629 | XP_010491325.1 | putative two-component response regulator ARR21 | AT5G07210 | ARR21 | response regulator 21 [Source:TAIR;Acc: AT5G07210] |
| Csa20g009630 SEQ ID NO: 199 | 0.9753 | XP_010491330.1 | homeobox-leucine zipper protein ANTHOCYANINLESS 2-like | AT5G07260 | AT5G07260 | START (StAR-related lipid-transfer) lipid-binding domain-containing protein |
| Csa20g082160 SEQ ID NO: 41*** | 0.9618 | XP_010495006.1 | nuclear transcription factor Y subunit B-6 isoform X1 | AT5G47670 | NYFB-6 | nuclear factor Y, subunit B6 (NF-YB6) |

[1]The top 50 hub genes include transcription factor and non-transcription factor genes.
[2]kME is a measure of the membership value of a gene with respect to the module.
*Indicates TF genes that are common in TABLE 5 and TABLE 7.
**Indicates TF genes that are common in TABLE 5 and TABLE 8.
***Indicates TF genes that are common in TABLE 5, TABLE 7, and TABLE 8.

Example 3. Identification of Novel Regulators (TFs) to Increase Seed Yield and/or Oil Content In order to further explore the association of the 211 transcription factors to the enriched biological processes within the brown module, the correlations of transcription factor genes to the top ten overrepresented pathways in the brown module were computed using a TF-module association network. TABLE 6 shows the network for the top 26 transcription factor genes. The top ten pathways that are overrepresented in the brown module, and their abbreviations in TABLE 6, are lipid metabolic process (Lipid MP), fatty acid metabolic process (FA MP), seed development (Seed dev), fatty acid biosynthetic process (FA BP), seed coat development (Seed coat dev), lipid biosynthetic process (Lipid BP), seed maturation (Seed mat), post regulation of metabolic process (Pos reg MP), lipid transport (Lipid transport), and carbohydrate metabolic processes (Carb MP). Each cell in TABLE 6 represents the TF pathway association score that is calculated by taking the sum of the TF's connectivities to the indicated pathway genes located within the brown module. The value in each cell is normalized by dividing the connectivities by the total number of genes in each pathway that are located within the module. A value close to 0.5 indicates a strong association of the pathway genes to the TF gene.

TABLE 6

Transcription factor (TF)-module association network for the brown module[1]

| Camelina Gene ID | Lipid MP | FA MP | Seed dev | FA BP | Seed coat dev | Lipid BP | Seed mat | Pos reg MP | Lipid transport | Carb MP |
|---|---|---|---|---|---|---|---|---|---|---|
| Csa02g028180 | 0.21 | 0.23 | 0.27 | 0.26 | 0.42 | 0.20 | 0.21 | 0.30 | 0.25 | 0.22 |
| Csa03g025850 | 0.17 | 0.20 | 0.22 | 0.23 | 0.35 | 0.16 | 0.15 | 0.24 | 0.24 | 0.18 |
| Csa02g039160 | 0.23 | 0.24 | 0.26 | 0.26 | 0.32 | 0.22 | 0.29 | 0.31 | 0.30 | 0.22 |
| Csa04g012470 | 0.21 | 0.18 | 0.30 | 0.20 | 0.21 | 0.20 | 0.44 | 0.28 | 0.32 | 0.19 |
| Csa06g028810 | 0.20 | 0.26 | 0.20 | 0.31 | 0.28 | 0.23 | 0.16 | 0.24 | 0.18 | 0.20 |
| Csa06g017080 | 0.24 | 0.22 | 0.31 | 0.25 | 0.24 | 0.23 | 0.44 | 0.30 | 0.33 | 0.22 |
| Csa07g034190 | 0.29 | 0.31 | 0.35 | 0.35 | 0.39 | 0.29 | 0.40 | 0.38 | 0.37 | 0.28 |
| Csa04g015890 | 0.28 | 0.30 | 0.34 | 0.35 | 0.43 | 0.27 | 0.38 | 0.37 | 0.36 | 0.27 |
| Csa04g040410 | 0.16 | 0.17 | 0.20 | 0.20 | 0.28 | 0.16 | 0.18 | 0.28 | 0.18 | 0.16 |
| Csa08g010060 | 0.22 | 0.21 | 0.27 | 0.23 | 0.22 | 0.22 | 0.36 | 0.29 | 0.29 | 0.21 |
| Csa05g084910 | 0.28 | 0.30 | 0.34 | 0.34 | 0.38 | 0.28 | 0.39 | 0.37 | 0.37 | 0.27 |
| Csa09g015930 | 0.28 | 0.31 | 0.34 | 0.36 | 0.44 | 0.28 | 0.36 | 0.39 | 0.37 | 0.28 |
| Csa09g064030 | 0.21 | 0.27 | 0.22 | 0.33 | 0.30 | 0.24 | 0.18 | 0.26 | 0.20 | 0.21 |
| Csa11g012280 | 0.26 | 0.27 | 0.34 | 0.31 | 0.37 | 0.25 | 0.41 | 0.36 | 0.36 | 0.25 |
| Csa11g064030 | 0.28 | 0.30 | 0.33 | 0.35 | 0.39 | 0.27 | 0.37 | 0.36 | 0.36 | 0.27 |
| Csa10g022470 | 0.24 | 0.28 | 0.30 | 0.32 | 0.43 | 0.24 | 0.28 | 0.33 | 0.32 | 0.25 |
| Csa12g003340 | 0.25 | 0.28 | 0.30 | 0.31 | 0.42 | 0.24 | 0.27 | 0.34 | 0.33 | 0.25 |
| Csa13g016510 | 0.24 | 0.21 | 0.31 | 0.24 | 0.26 | 0.23 | 0.42 | 0.33 | 0.32 | 0.22 |
| Csa13g044940 | 0.20 | 0.21 | 0.26 | 0.25 | 0.36 | 0.20 | 0.25 | 0.32 | 0.25 | 0.21 |
| Csa13g009540 | 0.25 | 0.24 | 0.32 | 0.28 | 0.26 | 0.24 | 0.45 | 0.31 | 0.35 | 0.23 |
| Csa16g028530 | 0.28 | 0.31 | 0.35 | 0.36 | 0.41 | 0.28 | 0.38 | 0.38 | 0.37 | 0.28 |

TABLE 6-continued

Transcription factor (TF)-module association network for the brown module[1]

| Camelina Gene ID | Lipid MP | FA MP | Seed dev | FA BP | Seed coat dev | Lipid BP | Seed mat | Pos reg MP | Lipid transport | Carb MP |
|---|---|---|---|---|---|---|---|---|---|---|
| Csa17g028800 | 0.19 | 0.23 | 0.23 | 0.26 | 0.36 | 0.19 | 0.19 | 0.26 | 0.27 | 0.20 |
| Csa20g009570 | 0.23 | 0.24 | 0.27 | 0.28 | 0.40 | 0.22 | 0.25 | 0.31 | 0.26 | 0.23 |
| Csa20g009930 | 0.25 | 0.25 | 0.34 | 0.28 | 0.28 | 0.25 | 0.47 | 0.33 | 0.36 | 0.24 |
| Csa20g082160 | 0.27 | 0.30 | 0.32 | 0.34 | 0.38 | 0.27 | 0.36 | 0.35 | 0.35 | 0.26 |
| Csa03g055650 | 0.21 | 0.22 | 0.27 | 0.25 | 0.35 | 0.20 | 0.29 | 0.31 | 0.30 | 0.21 |

[1]Abbreviations: Lipid MP: lipid metabolic process; FA MP: fatty acid metabolic process; Seed dev: seed development; FA BP: fatty acid biosynthetic process; Seed coat dev: seed coat development; Lipid BP: lipid biosynthetic process; Seed mat: seed maturation; Post reg MP: post regulation of metabolic process; Carb MP: carbohydrate metabolic processes.

TABLE 7 lists the top TF candidates that were obtained through this analysis that contain the strongest association to the major metabolic pathways that are considered as core pathways for increasing seed oil content and seed yield. Interestingly, some of the genes that are known to have a large effect on oil biosynthesis and/or seed yield, such as WRINKLED1 (WRI1, Ma et al., PLoS One, 2013, 8, e68887), LEAFY COTYLEDON 1-LIKE (LEC1-LIKE, referred to as NFYB6 in tables, Tan et al., 2011, 156, 1577-1588), and LEAFY COTYLEDON 1 (LEC1, referred to as NFYB-9 in tables) (Tan et al., 2011) were found in the top candidate list of transcription factors (TABLE 7).

TABLE 7

Candidate *Camelina sativa* transcription factors to increase seed yield and/or oil content identified in the brown module of the TF-module association network

| Csa locus | *C. sativa* gene description | NCBI ID | A. thaliana gene | A. thaliana best BLAST hit |
|---|---|---|---|---|
| Csa02g028180 SEQ ID NO: 14*** | LOW QUALITY PROTEIN: transcription factor TT8-like | XP_010437974.1 | TT8-like | AT4G09820 |
| Csa03g025850 SEQ ID NO: 58*** | nuclear transcription factor Y subunit B-9-like isoform X1 | XP_010498656.1 | NFYB-9 | AT1G21970 |
| Csa02g039160 SEQ ID NO: 203 | nuclear transcription factor Y subunit C-6-like | XP_010442179.1 | NFYC-6like | AT5G50480 |
| Csa04g012470 SEQ ID NO: 178* | B3 domain-containing transcription factor FUS3-like | XP_019100092.1 | FUS3 | AT3G26790 |
| Csa06g028810 SEQ ID NO: 3*** | ethylene-responsive transcription factor WRI1 isoform X2 | XP_010515956.1 | WRI1 | AT3G54320 |
| Csa06g017080 SEQ ID NO: 184* | ABSCISIC ACID-INSENSITIVE 5-like protein | XP_019102243.1 | ABI5 | AT3G44460 |
| Csa07g034190 SEQ ID NO: 44*** | LOB domain-containing protein 42 | XP_010415471.1 | LOB | AT1G68510 |
| Csa04g015890 SEQ ID NO: 13*** | transcription factor MYB46-like | XP_010502784.1 | MYB-46 | AT3G27785 |
| Csa04g040410 SEQ ID NO: 54 | floral homeotic protein APETALA 3-like | XP_010504236.1 | APETALA3 | AT3G54340 |
| Csa08g010060 SEQ ID NO: 201 | WUSCHEL-related homeobox 12-like | XP_019084718.1 | WOX12 | AT5G17810 |
| Csa05g084910 SEQ ID NO: 182* | LOB domain-containing protein 42-like | XP_010511848.1 | LOB42 | AT1G68510 |
| Csa09g015930 SEQ ID NO: 16*** | transcription factor MYB98-like | XP_010425555.1 | MYB98 | AT3G27785 |
| Csa09g064030 SEQ ID NO: 1*** | ethylene-responsive transcription factor WRI1 isoform X2 | XP_010427125.1 | WRI1 | AT3G54320 |
| Csa11g012280 SEQ ID NO: 189* | ethylene-responsive transcription factor ERF015 | XP_010445038.1 | ERF015 | AT4G31060 |
| Csa11g064030 SEQ ID NO: 37*** | nuclear transcription factor Y subunit B-6 isoform X2 | XP_010441425.1 | NFYB6 | AT5G47670 |

TABLE 7-continued

Candidate *Camelina sativa* transcription factors to increase seed yield and/or oil content identified in the brown module of the TF-module association network

| Csa locus | *C. sativa* gene description | NCBI ID | *A. thaliana* gene | *A. thaliana* best BLAST hit |
|---|---|---|---|---|
| Csa10g022470 SEQ ID NO: 10*** | dof zinc finger protein DOF4.4-like | XP_010449133.1 | DOF4.4 | AT4G21050 |
| Csa12g003340 SEQ ID NO: 25*** | dof zinc finger protein DOF4.7-like [;*Camelina sativa*] | XP_010446600.1 | DOF4.7 | AT4G38000 |
| Csa13g016510 SEQ ID NO: 202 | agamous-like MADS-box protein AGL15 isoform X2 | XP_010453479.1 | AGL15 | AT5G13790 |
| Csa13g044940 SEQ ID NO: 33 | agamous-like MADS-box protein AGL11 isoform X2 | XP_010455384.1 | AGL11 | AT4G09960 |
| Csa13g009540 SEQ ID NO: 204 | zinc finger CCCH domain-containing protein 54-like | XP_010452718.1 | PEI1 (also known as ATTZF6) | AT5G07500 |
| Csa16g028530 SEQ ID NO: 27*** | LOB domain-containing protein 42-like | XP_010470800.1 | lob42 | AT1G68510 |
| Csa17g028800 SEQ ID NO: 42*** | nuclear transcription factor Y subunit B-9-like isoform X1 | XP_010477449.1 | NFYB-9 | AT1G21970 |
| Csa20g009570 SEQ ID NO: 19*** | putative two-component response regulator ARR21 | XP_010491325.1 | ARR21 | AT5G07210 |
| Csa20g009930 SEQ ID NO: 205 | zinc finger CCCH domain-containing protein 54 | XP_010491369.2 | ATTZF6 | AT5G07500 |
| Csa20g082160 SEQ ID NO: 41*** | nuclear transcription factor Y subunit B-6 isoform X1 | XP_010495006.1 | NFYB6 | AT5G47670 |
| Csa03g055650 SEQ ID NO: 237 | transcription factor bHLH95-like | XP_010500526.1 | bHLH95 | AT1G49770 |

*Indicates TF genes that are common in TABLE 5 and TABLE 7.
***Indicates TF genes that are common in TABLE 5, TABLE 7, and TABLE 8.

Example 4. Additional Transcription Factor Candidates Identified Through WGCNA

Additional transcription factor genes were identified from the WGCNA adjacency matrix constructed in Example 1 that may increase oil and/or seed yield. These transcription factors are listed in TABLE 8.

TABLE 8

Candidate[1] transcription factors to increase seed yield and/or oil content identified from WGCNA adjacency matrix in Example 1

| Csa locus | *C. sativa* description | *A. thaliana* best BLAST hit | *A. thaliana* gene | *A. thaliana* description |
|---|---|---|---|---|
| Csa09g064030 SEQ ID NO: 1*** | ethylene-responsive transcription factor WRI1, transcript variant X2 | AT3G54320 | WRI1 | Ethylene-responsive transcription factor WRI1 |
| Csa20g025980 SEQ ID NO: 2 | transcription repressor MYB6-like | AT5G17800 | MYB56 | Transcription factor MYB56 |
| Csa06g028810 SEQ ID NO: 3*** | ethylene-responsive transcription factor WRI1, transcript variant X2 | AT3G54320 | WRI1 | Ethylene-responsive transcription factor WRI1 |
| Csa04g040400 SEQ ID NO: 4** | ethylene-responsive transcription factor WRI1-like, transcript variant X2 | AT3G54320 | WRI1 | Ethylene-responsive transcription factor WRI1 |
| Csa17g083180 SEQ ID NO: 5 | B3 domain-containing protein At1g49475-like | AT1G49475 | At1g49475 | B3 domain-containing protein At1g49475 |
| Csa08g010050 SEQ ID NO: 6 | myb-related protein 315-like | AT5G17800 | MYB56 | Transcription factor MYB56 |
| Csa04g059420 SEQ ID NO: 7 | agamous-like MADS-box protein AGL5, transcript variant X1 | AT2G42830 | AGL5 | Agamous-like MADS-box protein AGL5 |

TABLE 8-continued

Candidate[1] transcription factors to increase seed yield and/or oil content identified from WGCNA adjacency matrix in Example 1

| Csa locus | C. sativa description | A. thaliana best BLAST hit | A. thaliana gene | A. thaliana description |
|---|---|---|---|---|
| Csa06g008890 SEQ ID NO: 8** | transcription factor MYB98-like | AT3G27785 | MYB118 | Transcription factor MYB118 |
| Csa13g044750 SEQ ID NO: 9** | transcription factor TT8-like | AT4G09820 | TT8 | Transcription factor TT8 |
| Csa10g022470 SEQ ID NO: 10*** | Dof family protein | AT4G21050 | DOF4.4 | Dof zinc finger protein DOF4.4 |
| Csa05g008730 SEQ ID NO: 11** | MIKC_MADS family protein | AT2G42830 | AGL5 | Agamous-like MADS-box protein AGL5 |
| Csa13g020620 SEQ ID NO: 12 | MYB family protein | AT5G17800 | MYB56 | Transcription factor MYB56 |
| Csa04g015890 SEQ ID NO: 13 | transcription factor MYB46-like | AT3G27785 | MYB118 | Transcription factor MYB118 |
| Csa02g028180 SEQ ID NO: 14*** | transcription factor TT8-like | AT4G09820 | TT8 | Transcription factor TT8 |
| Csa06g048980 SEQ ID NO: 15 | agamous-like MADS-box protein AGL5, transcript variant X2 | AT2G42830 | AGL5 | Agamous-like MADS-box protein AGL5 |
| Csa09g015930 SEQ ID NO: 16*** | transcription factor MYB98-like | AT3G27785 | MYB118 | Transcription factor MYB118 |
| Csa17g013010 SEQ ID NO: 17 | transcription repressor MYB6-like | AT1G09540 | MYB61 | Transcription factor MYB61 |
| Csa19g026420 SEQ ID NO: 18 | B3 domain-containing protein At3g18960-like | AT3G18960 | At3g18960 | B3 domain-containing protein At3g18960 |
| Csa20g009570 SEQ ID NO: 19*** | putative two-component response regulator ARR21 | AT5G07210 | ARR21 | Putative two-component response regulator ARR21 |
| Csa02g001270 SEQ ID NO: 20 | LOB domain-containing protein 30 | AT4G00220 | LBD30 | LOB domain-containing protein 30 |
| Csa08g037600 SEQ ID NO: 21** | transcription factor TT8 | AT4G09820 | TT8 | Transcription factor TT8 |
| Csa15g017660 SEQ ID NO: 22 | transcription repressor MYB5 | AT3G13540 | MYB5 | Transcription repressor MYB5 |
| Csa04g063340 SEQ ID NO: 23 | LOB domain-containing protein 18 | AT2G45420 | LBD18 | LOB domain-containing protein 18 |
| Csa08g001290 SEQ ID NO: 24 | LOB domain-containing protein 30-like | AT4G00220 | LBD30 | LOB domain-containing protein 30 |
| Csa12g003340 SEQ ID NO: 25*** | dof zinc finger protein DOF4.7-like | AT4G38000 | DOF4.7 | Dof zinc finger protein DOF4.7 |
| Csa14g010940 SEQ ID NO: 26 | transcription repressor MYB6-like | AT1G09540 | MYB61 | Transcription factor MYB61 |
| Csa16g028530 SEQ ID NO: 27*** | LOB domain-containing protein 42-like | AT1G68510 | LBD42 | LOB domain-containing protein 42 |
| Csa10g003120 SEQ ID NO: 28 | dof zinc finger protein DOF4.7-like | AT4G38000 | DOF4.7 | Dof zinc finger protein DOF4.7 |
| Csa02g067030 SEQ ID NO: 29 | B3 domain-containing protein At5g60140-like | AT5G60140 | At5g60140 | B3 domain-containing protein At5g60140 |
| Csa15g027280 SEQ ID NO: 30 | bHLH family protein | AT3G19500 | BHLH113 | Transcription factor bHLH 113 |
| Csa05g024520 SEQ ID NO: 31 | HD-ZIP family protein | AT2G32370 | HDG3 | Homeobox-leucine zipper protein HDG3 |
| Csa07g054640 SEQ ID NO: 32 | B3 family protein | AT4G00260 | REM15.15 | Putative B3 domain-containing protein REM15 |
| Csa13g044940 SEQ ID NO: 33 | MIKC_MADS family protein | AT4G09960 | AGL11 | Agamous-like MADS-box protein AGL11 |
| Csa03g012900 SEQ ID NO: 34 | transcription repressor MYB6-like | AT1G09540 | MYB61 | Transcription factor MYB61 |
| Csa20g048870 SEQ ID NO: 35 | B3 domain-containing protein At5g25470-like | AT5G25475 | At5g25475 | B3 domain-containing protein At5g25475 |
| Csa20g081120 SEQ ID NO: 36 | homeobox-leucine zipper protein HDG5-like, transcript variant X1 | AT5G46880 | HDG5 | Homeobox-leucine zipper protein HDG5 |
| Csa11g064030 SEQ ID NO: 37*** | NF-YB family protein | AT5G47670 | NFYB6 | nuclear factor Y, subunit B6 |
| Csa19g027040 SEQ ID NO: 38 | transcription factor bHLH113 | AT3G19500 | BHLH113 | Transcription factor bHLH113 |

TABLE 8-continued

Candidate[1] transcription factors to increase seed yield and/or oil content identified from WGCNA adjacency matrix in Example 1

| Csa locus | *C. sativa* description | *A. thaliana* best BLAST hit | *A. thaliana* gene | *A. thaliana* description |
|---|---|---|---|---|
| Csa11g065050 SEQ ID NO: 39 | homeobox-leucine zipper protein HDG5-like | AT5G46880 | HDG5 | Homeobox-leucine zipper protein HDG5 |
| Csa08g038790 SEQ ID NO: 40 | MIKC_MADS family protein | AT4G09960 | AGL11 | Agamous-like MADS-box protein AGL11 |
| Csa20g082160 SEQ ID NO: 41*** | nuclear transcription factor Y subunit B-6-like | AT5G47670 | NFYB6 | Nuclear transcription factor Y subunit B-6 |
| Csa17g028800 SEQ ID NO: 42*** | nuclear transcription factor Y subunit B-9-like, transcript variant X2 | AT1G21970 | NFYB9 | Nuclear transcription factor Y subunit B-9 |
| Csa18g030810 SEQ ID NO: 43 | B3 family protein | AT5G57720 | At5g57720 | B3 domain-containing protein At5g57720 |
| Csa07g034190 SEQ ID NO: 44*** | LOB domain-containing protein 42 | AT1G68510 | LBD42 | LOB domain-containing protein 42 |
| Csa19g018880 SEQ ID NO: 45 | transcription repressor MYB5-like | AT3G13540 | MYB5 | Transcription repressor MYB5 |
| Csa14g027200 SEQ ID NO: 46** | nuclear transcription factor Y subunit B-9, transcript variant X2 | AT1G21970 | NFYB9 | Nuclear transcription factor Y subunit B-9 |
| Csa09g064040 SEQ ID NO: 47 | MIKC_MADS family protein | AT3G54340 | AP3 | Floral homeotic protein APETALA 3 |
| Csa18g002140 SEQ ID NO: 48 | nuclear transcription factor Y subunit B-6-like, transcript variant X2 | AT5G47670 | NFYB6 | Nuclear transcription factor Y subunit B-6 |
| Csa01g003470 SEQ ID NO: 49 | LOB domain-containing protein 20-like | AT3G03760 | LBD20 | LOB domain-containing protein 20 |
| Csa06g051800 SEQ ID NO: 50 | LOB domain-containing protein 18-like | AT2G45420 | LBD18 | LOB domain-containing protein 18 |
| Csa15g001870 SEQ ID NO: 51 | developmental protein SEPALLATA 2 | AT3G02310 | SEP2 | Developmental protein SEPALLATA 2 |
| Csa06g051300 SEQ ID NO: 52 | homeobox-leucine zipper protein ATHB-4-like | AT2G44910 | ATHB-4 | Homeobox-leucine zipper protein ATHB-4 |
| Csa01g022540 SEQ ID NO: 53 | transcription factor bHLH113-like | AT3G19500 | BHLH113 | Transcription factor bHLH113 |
| Csa04g040410 SEQ ID NO: 54 | floral homeotic protein APETALA 3-like | AT3G54340 | AP3 | Floral homeotic protein APETALA 3 |
| Csa15g026630 SEQ ID NO: 55 | B3 family protein | AT3G18960 | At3g18960 | B3 family protein |
| Csa15g003590 SEQ ID NO: 56 | LOB domain-containing protein 20-like | AT3G03760 | LBD20 | LOB domain-containing protein 20 |
| Csa19g005910 SEQ ID NO: 57 | LOB domain-containing protein 20 | AT3G03760 | LBD20 | LOB domain-containing protein 20 |
| Csa03g025850 SEQ ID NO: 58*** | nuclear transcription factor Y subunit B-9-like, transcript variant X1 | AT1G21970 | NFYB9 | Nuclear transcription factor Y subunit B-9 |
| Csa18g003140 SEQ ID NO: 59 | homeobox-leucine zipper protein HDG5 | AT5G46880 | HDG5 | Homeobox-leucine zipper protein HDG5 |
| Csa08g007940 SEQ ID NO: 60 | MIKC_MADS family protein | AT5G15800 | SEP1 | Developmental protein SEPALLATA 1 |
| Csa16g008940 SEQ ID NO: 61 | no hit on PlantTFDB | AT2G32460 | MYB101 | Transcription factor MYB101 |
| Csa08g056710 SEQ ID NO: 62 | NAC family protein | AT5G07680 | NAC079 | NAC domain-containing protein 79 |
| Csa13g056870 SEQ ID NO: 63 | myb-related protein 3R-1-like, transcript variant X1 | AT4G00540 | MYB3R2 | Transcription factor MYB3R-2 |
| Csa01g015840 SEQ ID NO: 64 | transcription repressor MYB5, transcript variant X2 | AT3G13540 | MYB5 | Transcription repressor MYB5 |
| Csa02g026980 SEQ ID NO: 65 | agamous-like MADS-box protein AGL11, transcript variant X1 | AT4G09960 | AGL11 | Agamous-like MADS-box protein AGL11 |
| Csa13g057190 SEQ ID NO: 66 | LOB domain-containing protein 30-like | AT4G00220 | LBD30 | LOB domain-containing protein 30 |
| Csa11g009840 SEQ ID NO: 67 | B3 family protein | AT4G33280 | REM16 | B3 domain-containing protein REM16 |
| Csa05g094940 SEQ ID NO: 68 | transcription factor MYB12-like | AT3G62610 | MYB11 | Transcription factor MYB11 |
| Csa17g021380 SEQ ID NO: 69 | no hit on PlantTFDB | AT1G15790 | At1g15790 | Mediator of RNA polymerase II transcription subunit 15a-like protein |
| Csa11g003480 SEQ ID NO: 70 | dof zinc finger protein DOF4.7-like | AT4G38000 | DOF4.7 | Dof zinc finger protein DOF4.7 |
| Csa16g046300 SEQ ID NO: 71 | B3 domain-containing protein REM14-like | AT4G00260 | REM15.15 | Putative B3 domain-containing protein REM15 |

TABLE 8-continued

Candidate[1] transcription factors to increase seed yield and/or oil content identified from WGCNA adjacency matrix in Example 1

| Csa locus | *C. sativa* description | *A. thaliana* best BLAST hit | *A. thaliana* gene | *A. thaliana* description |
|---|---|---|---|---|
| Csa01g001860 SEQ ID NO: 72 | MIKC_MADS family protein | AT3G02310 | SEP2 | Developmental protein SEPALLATA 2 |
| Csa11g025480 SEQ ID NO: 73 | dof zinc finger protein DOF4.4-like | AT4G21050 | DOF4.4 | Dof zinc finger protein DOF4.4 |
| Csa06g028820 SEQ ID NO: 74 | MIKC_MADS family protein | AT3G54340 | AP3 | Floral homeotic protein APETALA 3 |
| Csa03g055340 SEQ ID NO: 75 | B3 domain-containing protein At1g49475-like | AT1G49475 | At1g49475 | B3 domain-containing protein At1g49475 |
| Csa13g020090 SEQ ID NO: 76** | homeobox-leucine zipper protein HDG9-like | AT5G17320 | HDG9 | Homeobox-leucine zipper protein HDG9 |
| Csa07g060030 SEQ ID NO: 77 | HD-ZIP family protein | AT1G79840 | GL2 | Homeobox-leucine zipper protein GLABRA 2 |
| Csa20g025400 SEQ ID NO: 78 | homeobox-leucine zipper protein HDG9-like | AT1G34650 | HDG10 | Homeobox-leucine zipper protein HDG10 |
| Csa19g005080 SEQ ID NO: 79 | no hit on PlantTFDB | AT3G02940 | MYB107 | Myb domain protein 107 |
| Csa14g041570 SEQ ID NO: 80** | agamous-like MADS-box protein AGL86 | AT1G31630 | AGL86 | Agamous-like MADS-box protein AGL86 |
| Csa02g004620 SEQ ID NO: 81 | B3 domain-containing transcription factor NGA4-like | AT4G01500 | NGA4 | B3 domain-containing transcription factor NGA4 |
| Csa18g021260 SEQ ID NO: 82** | nuclear transcription factor Y subunit C-6-like | AT5G50480 | NFYC6 | Nuclear transcription factor Y subunit C-6 |
| Csa11g097230 SEQ ID NO: 83 | NAC domain-containing protein 100 | AT5G61430 | NAC100 | NAC domain-containing protein 100 |
| Csa11g081940 SEQ ID NO: 84 | nuclear transcription factor Y subunit C-6-like | AT5G50480 | NFYC6 | Nuclear transcription factor Y subunit C-6 |
| Csa19g002950 SEQ ID NO: 85 | MIKC_MADS family protein | AT3G02310 | SEP2 | Developmental protein SEPALLATA 2 |
| Csa13g018600 SEQ ID NO: 86 | MIKC_MADS family protein | AT5G15800 | SEP1 | Developmental protein SEPALLATA 1 |
| Csa18g005150 SEQ ID NO: 87 | WUSCHEL-related homeobox 8-like | AT5G45980 | WOX8 | WUSCHEL-related homeobox 8 |
| Csa15g059710 SEQ ID NO: 88 | growth-regulating factor 6 | AT2G06200 | GRF6 | Growth-regulating factor 6 |
| Csa02g068380 SEQ ID NO: 89 | transcription factor MYB28-like | AT5G61420 | MYB28 | Transcription factor MYB28 |
| Csa04g018190 SEQ ID NO: 90 | mini zinc finger protein 2-like | AT3G28917 | MIF2 | Mini zinc finger protein 2 |
| Csa18g034740 SEQ ID NO: 91 | transcription factor MYB28 | AT5G61420 | MYB28 | Transcription factor MYB28 |
| Csa05g085820 SEQ ID NO: 92** | MIKC_MADS family protein | AT1G69120 | AP1 | Floral homeotic protein APETALA 1 |
| Csa09g021300 SEQ ID NO: 93 | mini zinc finger protein 2-like | AT3G28917 | MIF2 | Mini zinc finger protein 2 |
| Csa03g030490 SEQ ID NO: 94 | developmental protein SEPALLATA 3, transcript variant X8 | AT1G24260 | SEP3 | Developmental protein SEPALLATA 3 |
| Csa03g031590 SEQ ID NO: 95 | B3 domain-containing transcription factor LEC2-like, transcript variant X1 | AT1G28300 | LEC2 | B3 domain-containing transcription factor LEC2 |
| Csa18g033440 SEQ ID NO: 96 | B3 domain-containing protein At5g60140-like | AT5G60130 | At5g60130 | B3 domain-containing protein At5g60130 |
| Csa20g038200 SEQ ID NO: 97 | protein TRANSPARENT TESTA 16-like, transcript variant X2 | AT5G23260 | TT16 | Protein TRANSPARENT TESTA 16 |
| Csa09g095190 SEQ ID NO: 98 | homeobox-leucine zipper protein GLABRA 2-like | AT1G79840 | GL2 | Homeobox-leucine zipper protein GLABRA 2 |
| Csa01g002590 SEQ ID NO: 99 | transcription factor MYB3-like | AT3G02940 | MYB107 | Myb domain protein 107 |
| Csa12g037530 SEQ ID NO: 100 | dof zinc finger protein DOF4.4-like | AT4G21050 | DOF4.4 | Dof zinc finger protein DOF4.4 |
| Csa03g026440 SEQ ID NO: 101 | agamous-like MADS-box protein AGL80, transcript variant X1 | AT1G22590 | AGL87 | AGAMOUS-like 87 |
| Csa13g027840 SEQ ID NO: 102 | protein TRANSPARENT TESTA 16-like | AT5G23260 | TT16 | Protein TRANSPARENT TESTA 16 |
| Csa14g034830 SEQ ID NO: 103 | developmental protein SEPALLATA 3, transcript variant X4 | AT1G24260 | SEP3 | Developmental protein SEPALLATA 3 |

TABLE 8-continued

Candidate[1] transcription factors to increase seed yield and/or oil content identified from WGCNA adjacency matrix in Example 1

| Csa locus | C. sativa description | A. thaliana best BLAST hit | A. thaliana gene | A. thaliana description |
|---|---|---|---|---|
| Csa20g023310 SEQ ID NO: 104 | developmental protein SEPALLATA 1 | AT2G03710 | AGL3 | Agamous-like MADS-box protein AGL3 |
| Csa16g050670 SEQ ID NO: 105 | HD-ZIP family protein | AT1G79840 | GL2 | Homeobox-leucine zipper protein GLABRA 2 |
| Csa06g027310 SEQ ID NO: 106 | growth-regulating factor 4 | AT3G52910 | GRF4 | Growth-regulating factor 4 |
| Csa14g035910 SEQ ID NO: 107 | B3 family protein | AT1G28300 | LEC2 | B3 domain-containing transcription factor LEC2 |
| Csa13g009710 SEQ ID NO: 108 | NAC domain-containing protein 79-like | AT5G07680 | NAC079 | NAC domain-containing protein 79 |
| Csa15g002660 SEQ ID NO: 109 | MYB family protein | AT3G02940 | MYB107 | Myb domain protein 107 |
| Csa18g034760 SEQ ID NO: 110 | NAC domain-containing protein 100-like | AT5G61430 | NAC100 | NAC domain-containing protein 100 |
| Csa17g029500 SEQ ID NO: 111 | M-type_MADS family protein | AT1G22590 | AGL87 | AGAMOUS-like 87 |
| Csa15g020050 SEQ ID NO: 112 | NAC transcription factor 56-like | AT3G15510 | NAC056 | NAC transcription factor 56 |
| Csa05g004070 SEQ ID NO: 113 | axial regulator YABBY 1 | AT2G45190 | YAB1 | Axial regulator YABBY 1 |
| Csa06g051580 SEQ ID NO: 114 | axial regulator YABBY 1 | AT2G45190 | YAB1 | Axial regulator YABBY 1 |
| Csa09g088810 SEQ ID NO: 115 | B3 domain-containing protein REM14-like, transcript variant X1 | AT4G00260 | REM15.15 | Putative B3 domain-containing protein REM15 |
| Csa04g046300 SEQ ID NO: 116 | agamous-like MADS-box protein AGL1 | AT3G58780 | AGL1 | Agamous-like MADS-box protein AGL1 |
| Csa04g063090 SEQ ID NO: 117 | axial regulator YABBY 1 | AT2G45190 | YAB1 | Axial regulator YABBY 1 |
| Csa05g024410 SEQ ID NO: 118 | transcription factor GAMYB-like, transcript variant X2 | AT2G32460 | MYB101 | Transcription factor MYB101 |
| Csa07g010180 SEQ ID NO: 119 | transcription factor GAMYB-like | AT2G32460 | MYB101 | Transcription factor MYB101 |
| Csa19g004650 SEQ ID NO: 120 | LOB domain-containing protein 41-like | AT3G02550 | LBD41 | LOB domain-containing protein 41 |
| Csa19g028720 SEQ ID NO: 121 | GATA family protein | AT3G20750 | GATA29 | GATA transcription factor 29 |
| Csa17g035980 SEQ ID NO: 122 | developmental protein SEPALLATA 3-like, transcript variant X3 | AT1G24260 | SEP3 | Developmental protein SEPALLATA 3 |
| Csa20g026650 SEQ ID NO: 123 | NAC domain-containing protein 100-like | AT5G18270 | NAC087 | NAC domain-containing protein 87 |
| Csa08g010750 SEQ ID NO: 124 | NAC domain-containing protein 92-like | AT5G18270 | NAC087 | NAC domain-containing protein 87 |
| Csa13g019570 SEQ ID NO: 125 | transcription factor MYB39-like, transcript variant X2 | AT5G16770 | MYB9 | Myb domain protein 9 |
| Csa09g095630 SEQ ID NO: 126 | NAC family protein | AT1G61110 | NAC025 | NAC domain containing protein 25 |
| Csa13g021170 SEQ ID NO: 127 | NAC domain-containing protein 92 | AT5G18270 | NAC087 | NAC domain-containing protein 87 |
| Csa18g038180 SEQ ID NO: 128 | NAC family protein | AT5G64530 | NAC104 | NAC domain-containing protein 104 |
| Csa17g039350 SEQ ID NO: 129 | NAC domain-containing protein 10 | AT1G28470 | NAC010 | NAC domain-containing protein 10 |
| Csa02g073300 SEQ ID NO: 130 | NAC domain-containing protein 104-like | AT5G64530 | NAC104 | NAC domain-containing protein 104 |
| Csa20g024680 SEQ ID NO: 131 | transcription factor MYB39-like, transcript variant X1 | AT5G16770 | MYB9 | Myb domain protein 9 |
| Csa09g061160 SEQ ID NO: 132 | growth-regulating factor 4-like | AT3G52910 | GRF4 | Growth-regulating factor 4 |
| Csa19g040820 SEQ ID NO: 133 | GRF family protein | AT2G06200 | GRF6 | Growth-regulating factor 6 |
| Csa16g009060 SEQ ID NO: 134 | HD-ZIP family protein | AT2G32370 | HDG3 | Homeobox-leucine zipper protein HDG3 |
| Csa01g002130 SEQ ID NO: 135 | LOB domain-containing protein 41 | AT3G02550 | LBD41 | LOB domain-containing protein 41 |
| Csa07g054730 SEQ ID NO: 136 | B3 domain-containing protein REM-like 2 | AT2G24696 | At2g24696 | B3 domain-containing protein REM-like 2 |
| Csa08g008960 SEQ ID NO: 137 | MYB family protein | AT5G16770 | MYB9 | Myb domain protein 9 |
| Csa05g085100 SEQ ID NO: 138 | bZIP family protein | AT1G68640 | PAN | Transcription factor PERIANTHIA |
| Csa09g079830 SEQ ID NO: 139 | zinc-finger homeodomain protein 5, transcript variant X1 | AT1G75240 | ZHD5 | Zinc-finger homeodomain protein 5 |

TABLE 8-continued

Candidate[1] transcription factors to increase seed yield and/or oil content identified from WGCNA adjacency matrix in Example 1

| Csa locus | *C. sativa* description | *A. thaliana* best BLAST hit | *A. thaliana* gene | *A. thaliana* description |
|---|---|---|---|---|
| Csa15g002200 SEQ ID NO: 140 | LOB domain-containing protein 41-like | AT3G02550 | LBD41 | LOB domain-containing protein 41 |
| Csa07g011710 SEQ ID NO: 141 | myb-related protein Myb4-like | AT2G31180 | MYB14 | Transcription factor MYB14 |
| Csa01g021240 SEQ ID NO: 142 | NAC family protein | AT3G18400 | NAC058 | NAC domain containing protein 58 |
| Csa15g024970 SEQ ID NO: 143 | NAC family protein | AT3G18400 | NAC058 | NAC domain containing protein 58 |
| Csa08g054280 SEQ ID NO: 144 | transcription factor MYB39-like, transcript variant X2 | AT5G10280 | MYB92 | Transcription factor MYB92 |
| Csa04g041170 SEQ ID NO: 145 | AP2-like ethylene-responsive transcription factor SMZ | AT3G54990 | SMZ | AP2-like ethylene-responsive transcription factor SMZ |
| Csa16g039140 SEQ ID NO: 146 | zinc-finger homeodomain protein 5-like | AT1G75240 | ZHD5 | Zinc-finger homeodomain protein 5 |
| Csa20g015580 SEQ ID NO: 147 | transcription factor MYB39-like, transcript variant X2 | AT5G10280 | MYB92 | Transcription factor MYB92 |
| Csa17g001720 SEQ ID NO: 148 | ethylene-responsive transcription factor ERF023-like | AT1G01250 | ERF023 | Ethylene-responsive transcription factor ERF023 |
| Csa14g030660 SEQ ID NO: 149 | homeobox protein knotted-1-like 2 | AT1G70510 | KNAT2 | Homeobox protein knotted-1-like 2 |
| Csa16g012440 SEQ ID NO: 150 | myb-related protein Myb4-like | AT2G31180 | MYB14 | Transcription factor MYB14 |
| Csa07g046680 SEQ ID NO: 151 | zinc-finger homeodomain protein 5-like | AT1G75240 | ZHD5 | Zinc-finger homeodomain protein 5 |
| Csa13g055830 SEQ ID NO: 152 | transcription factor bHLH57-like | AT4G01460 | BHLH57 | Transcription factor bHLH57 |
| Csa17g076670 SEQ ID NO: 153 | C3H family protein | AT1G48195 | At1g48195 | Zinc finger CCCH domain-containing protein 13 |
| Csa10g03160 SEQ ID NO: 154 | agamous-like MADS-box protein AGL21, transcript variant X1 | AT4G37940 | AGL21 | Agamous-like MADS-box protein AGL21 |
| Csa05g030120 SEQ ID NO: 155 | myb-related protein Myb4-like | AT2G31180 | MYB14 | Transcription factor MYB14 |
| Csa11g003540 SEQ ID NO: 156 | no hit on PlantTFDB | AT4G37940 | AGL21 | Agamous-like MADS-box protein AGL21 |
| Csa03g01950 SEQ ID NO: 157 | ethylene-responsive transcription factor ERF023 | AT1G01250 | ERF023 | Ethylene-responsive transcription factor ERF023 |
| Csa12g037480 SEQ ID NO: 158 | Dof family protein | AT4G21080 | DOF4.5 | Dof zinc finger protein DOF4.5 |
| Csa10g046940 SEQ ID NO: 159 | NAC domain-containing protein 92 | AT5G39610 | NAC92 | NAC domain-containing protein 92 |
| Csa12g081820 SEQ ID NO: 160 | NAC domain-containing protein 92-like | AT5G39610 | NAC92 | NAC domain-containing protein 92 |
| Csa01g035280 SEQ ID NO: 161 | MADS-box transcription factor ANR1-like | AT2G14210 | ANR1 | MADS-box transcription factor ANR1 |
| Csa17g014180 SEQ ID NO: 162 | C2H2 family protein | AT1G10480 | ZFP5 | Zinc finger protein 5 |
| Csa11g055650 SEQ ID NO: 163 | NAC domain-containing protein 92 | AT5G39610 | NAC92 | NAC domain-containing protein 92 |
| Csa06g036530 SEQ ID NO: 164 | agamous-like MADS-box protein AGL1 | AT3G58780 | AGL1 | Agamous-like MADS-box protein AGL1 |
| Csa07g010290 SEQ ID NO: 165 | HD-ZIP family protein | AT2G32370 | HDG3 | Homeobox-leucine zipper protein HDG3 |
| Csa20g020460 SEQ ID NO: 166 | NAC domain-containing protein 83-like | AT5G14000 | NAC084 | NAC domain containing protein 84 |
| Csa03g052940 SEQ ID NO: 167 | C3H family protein | AT1G48195 | At1g48195 | Zinc finger CCCH domain-containing protein 13 |
| Csa07g034330 SEQ ID NO: 168 | transcription factor PERIANTHIA-like, transcript variant X1 | AT1G68640 | PAN | Transcription factor PERIANTHIA |
| Csa03g012890 SEQ ID NO: 169 | transcription factor PIF3-like | AT1G09530 | PIF3 | Transcription factor PIF3 |
| Csa07g030650 SEQ ID NO: 170 | bHLH family protein | AT1G66470 | BHLH83 | Transcription factor bHLH83 |
| Csa11g030760 SEQ ID NO: 171 | transcriptional regulator SUPERMAN-like | AT4G17810 | AXX17 | CYP705A1 |
| Csa08g022800 SEQ ID NO: 172 | C2H2 family protein | AT5G25160 | ZFP3 | Zinc finger protein 3 |
| Csa16g044520 SEQ ID NO: 173 | bHLH family protein | AT2G22770 | NAI1 | Transcription factor NAI1 |
| Csa03g060000 SEQ ID NO: 174 | NAC domain-containing protein 19-like | AT1G52890 | NAC019 | NAC domain-containing protein 19 |

TABLE 8-continued

Candidate[1] transcription factors to increase seed yield and/or oil content identified from WGCNA adjacency matrix in Example 1

| Csa locus | C. sativa description | A. thaliana best BLAST hit | A. thaliana gene | A. thaliana description |
|---|---|---|---|---|
| Csa17g093080 SEQ ID NO: 175 | NAC domain-containing protein 19-like | AT1G52890 | NAC019 | NAC domain-containing protein 19 |
| Csa01g018090 SEQ ID NO: 176 | NAC domain-containing protein 55 | AT3G15500 | NAC055 | NAC domain-containing protein 55 |

**Indicates TF genes that are common in TABLE 5 and TABLE 8.
***Indicates TF genes that are common in TABLE 5, TABLE 7, and TABLE 8.

Example 5. Overexpression of TFs in Oilseed Crops: Canola, Soybean, Corn, Camelina, Etc The TFs listed in TABLE 5, TABLE 7, and TABLE 8 can be overexpressed in oilseed crops to increase seed yield and/or oil content. Genetic constructs containing a promoter operably linked to the TF coding sequence, operably linked to a termination sequence can be constructed and transformed into the crop of interest. Appropriate constitutive and seed-specific promoters include those listed in TABLE 1 and TABLE 2 however those skilled in the art will understand that many other promoters can be used to practice the invention, depending on the tissue specificity and strength of the desired expression.

Canola Transformation.

For transformation of canola, vectors can be constructed to include a cassette for expression of the bar gene, providing resistance to the herbicide bialophos.

In preparation for plant transformation experiments, seeds of *Brassica napus* cv DH12075 (obtained from Agriculture and Agri-Food Canada) are surface sterilized with sufficient 95% ethanol for 15 seconds, followed by 15 minutes incubation with occasional agitation in full strength Javex (or other commercial bleach, 7.4% sodium hypochlorite) and a drop of wetting agent such as Tween 20. The Javex solution is decanted and 0.025% mercuric chloride with a drop of Tween 20 is added and the seeds are sterilized for another 10 minutes. The seeds are then rinsed three times with sterile distilled water. The sterilized seeds are plated on half strength hormone-free Murashige and Skoog (MS) media (Murashige T, Skoog F (1962). Physiol Plant 15:473-498) with 1% sucrose in 15×60 mm petri dishes that are then placed, with the lid removed, into a larger sterile vessel (Majenta GA7 jars). The cultures are kept at 25° C., with 16 h light/8 h dark, under approximately 70-80 µE of light intensity in a tissue culture cabinet. 4-5 days old seedlings are used to excise fully unfolded cotyledons along with a small segment of the hypocotyl. Excisions are made so as to ensure that no part of the apical meristem is included.

*Agrobacterium* strain GV3101 (pMP90) carrying the transformation construct of interest with an expression cassette for the bar gene, are grown overnight in 5 ml of LB media with 50 mg/L kanamycin, gentamycin, and rifampicin. The culture is centrifuged at 2000 g for 10 min., the supernatant is discarded and the pellet is suspended in 5 ml of inoculation medium (Murashige and Skoog with B5 vitamins (MS/B5; Gamborg O L, Miller R A, Ojima K. Exp Cell Res 50:151-158), 3% sucrose, 0.5 mg/L benzyl aminopurine (BA), pH 5.8). Cotyledons are collected in Petri dishes with ~1 ml of sterile water to keep them from wilting. The water is removed prior to inoculation and explants are inoculated in mixture of 1 part *Agrobacterium* suspension and 9 parts inoculation medium in a final volume sufficient to bathe the explants. After explants are well exposed to the *Agrobacterium* solution and inoculated, a pipet is used to remove any extra liquid from the petri dishes.

The Petri plates containing the explants incubated in the inoculation media are sealed and kept in the dark in a tissue culture cabinet set at 25° C. After 2 days the cultures are transferred to 4° C. and incubated in the dark for 3 days. The cotyledons, in batches of 10, are then transferred to selection medium consisting of Murashige Minimal Organics (Sigma), 3% sucrose, 4.5 mg/L BA, 500 mg/L MES, 27.8 mg/L Iron (II) sulfate heptahydrate, pH 5.8, 0.7% Phytagel with 300 mg/L timentin, and 2 mg/L L-phosphinothricin (L-PPT) added after autoclaving. The cultures are kept in a tissue culture cabinet set at 25° C., 16 h/8 h, with a light intensity of about 125 µmol $m^{-2}$ $s^{-1}$. The cotyledons are transferred to fresh selection every 3 weeks until shoots are obtained. The shoots are excised and transferred to shoot elongation media containing MS/B5 media, 2% sucrose, 0.5 mg/L BA, 0.03 mg/L gibberellic acid ($GA_3$), 500 mg/L 4-morpholineethanesulfonic acid (MES), 150 mg/L phloroglucinol, pH 5.8, 0.9% Phytagar and 300 mg/L timentin and 3 mg/L L-phosphinothricin added after autoclaving. After 3-4 weeks any callus that was formed at the base of shoots with normal morphology is cut off and shoots are transferred to rooting media containing half strength MS/B5 media with 1% sucrose and 0.5 mg/L indole butyric acid, 500 mg/L MES, pH 5.8, 0.8% agar, with 1.5 mg/L L-PPT and 300 mg/L timentin added after autoclaving. The plantlets with healthy shoots are hardened and transferred to 6 inch (15 cm) pots in the greenhouse to collect T1 transgenic seeds.

Screening of transgenic plants of canola expressing the TF gene to identify plants with higher yield is performed as follows. The T1 seeds of several independent lines are grown in a randomized complete block design in a greenhouse maintained at 24° C. during the day and 18° C. during the night. The T2 generation of seed from each line is harvested. Seed yield from each plant is determined by harvesting all of the mature seeds from a plant and drying them in an oven with mechanical convection set at 22° C. for two days. The weight of the entire harvested seed is recorded. The 100 seed weight is measured to obtain an indication of seed size. The oil content of seeds is measured using published procedures for preparation of fatty acid methyl esters (Malik et al. 2015, Plant Biotechnology Journal, 13, 675-688).

Soybean Transformation.

Transformation of soybean can be performed with the expression cassette for the TF gene of choice and an expression cassette for the selectable marker hygromycin resistance as follows. Purified DNA containing the expression cassettes are co-bombarded using biolistics into embryogenic cultures of soybean *Glycine max* cultivars X5 and Westag97 to obtain transgenic plants. The hygromycin resistance gene is expressed from a plant promoter, such as the soybean actin promoter and is flanked by a suitable 3' UTR.

The transformation, selection, and plant regeneration protocol is adapted from Simmonds (2003) (Simmonds, 2003, Genetic Transformation of Soybean with Biolistics. In: Jackson J F, Linskens H F (eds) *Genetic Transformation of Plants*. Springer Verlag, Berlin, pp 159-174) and is performed as follows.

Induction and Maintenance of Proliferative Embryogenic Cultures: Immature pods, containing 3-5 mm long embryos, are harvested from host plants grown at 28/24° C. (day/night), 15-h photoperiod at a light intensity of 300-400 µmol $m^{-2} s^{-1}$. Pods are sterilized for 30 s in 70% ethanol followed by 15 min in 1% sodium hypochlorite (with 1-2 drops of Tween 20 (Sigma, Oakville, ON, Canada)) and three rinses in sterile water. The embryonic axis is excised and explants are cultured with the abaxial surface in contact with the induction medium (MS salts, B5 vitamins (Gamborg O L, Miller R A, Ojima K. Exp Cell Res 50:151-158), 3% sucrose, 0.5 mg/L BA, pH 5.8), 1.25-3.5% glucose (concentration varies with genotype), 20 mg/l 2,4-D, pH 5.7). The explants, maintained at 20° C. at a 20-h photoperiod under cool white fluorescent lights at 35-75 µmol $m^{-2} s^{-1}$, are sub-cultured four times at 2-week intervals. Embryogenic clusters, observed after 3-8 weeks of culture depending on the genotype, are transferred to 125-ml Erlenmeyer flasks containing 30 ml of embryo proliferation medium containing 5 mM asparagine, 1-2.4% sucrose (concentration is genotype dependent), 10 mg/l 2,4-D, pH 5.0 and cultured as above at 35-60 µmol $m^{-2} s^{-1}$ of light on a rotary shaker at 125 rpm. Embryogenic tissue (30-60 mg) is selected, using an inverted microscope, for subculture every 4-5 weeks.

Transformation: Cultures are bombarded 3 days after subculture. The embryogenic clusters are blotted on sterile Whatman filter paper to remove the liquid medium, placed inside a 10×30-mm Petri dish on a 2×2 $cm^2$ tissue holder (PeCap, 1 005 µm pore size, Band SH Thompson and Co. Ltd. Scarborough, ON, Canada) and covered with a second tissue holder that is then gently pressed down to hold the clusters in place. Immediately before the first bombardment, the tissue is air dried in the laminar air flow hood with the Petri dish cover off for no longer than 5 min. The tissue is turned over, dried as before, bombarded on the second side and returned to the culture flask. The bombardment conditions used for the Biolistic PDS-I000/He Particle Delivery System are as follows: 737 mm Hg chamber vacuum pressure, 13 mm distance between rupture disc (Bio-Rad Laboratories Ltd., Mississauga, ON, Canada) and macrocarrier. The first bombardment uses 900 psi rupture discs and a microcarrier flight distance of 8.2 cm, and the second bombardment uses 1100 psi rupture discs and 11.4 cm microcarrier flight distance. DNA precipitation onto 1.0 µm diameter gold particles is carried out as follows: 2.5 µl of 100 ng/µl of DNA containing the expression cassette for the TF gene, and 2.5 µl of 100 ng/µl selectable marker DNA (cassette for hygromycin selection) are added to 3 mg gold particles suspended in 50 µl sterile $dH_2O$ and vortexed for 10 sec; 50 µl of 2.5 M $CaCl_2$ is added, vortexed for 5 sec, followed by the addition of 20 µl of 0.1 M spermidine which is also vortexed for 5 sec. The gold is then allowed to settle to the bottom of the microfuge tube (5-10 min) and the supernatant fluid is removed. The gold/DNA is resuspended in 200 µl of 100% ethanol, allowed to settle and the supernatant fluid is removed. The ethanol wash is repeated and the supernatant fluid is removed. The sediment is resuspended in 120 µl of 100% ethanol and aliquots of 8 µl are added to each macrocarrier. The gold is resuspended before each aliquot is removed. The macrocarriers are placed under vacuum to ensure complete evaporation of ethanol (about 5 min).

Selection: The bombarded tissue is cultured on embryo proliferation medium described above for 12 days prior to subculture to selection medium (embryo proliferation medium contains 55 mg/l hygromycin added to autoclaved media). The tissue is sub-cultured 5 days later and weekly for the following 9 weeks. Green colonies (putative transgenic events) are transferred to a well containing 1 ml of selection media in a 24-well multi-well plate that is maintained on a flask shaker as above. The media in multi-well dishes is replaced with fresh media every 2 weeks until the colonies are approximately 2-4 mm in diameter with proliferative embryos, at which time they are transferred to 125 ml Erlenmeyer flasks containing 30 ml of selection medium. A portion of the proembryos from transgenic events is harvested to examine gene expression by RT-PCR.

Plant regeneration: Maturation of embryos is carried out, without selection, at conditions described for embryo induction. Embryogenic clusters are cultured on Petri dishes containing maturation medium (MS salts, B5 vitamins, 6% maltose, 0.2% gelrite gellan gum (Sigma), 750 mg/l $MgCl_2$, pH 5.7) with 0.5% activated charcoal for 5-7 days and without activated charcoal for the following 3 weeks. Embryos (10-15 per event) with apical meristems are selected under a dissection microscope and cultured on a similar medium containing 0.6% phytagar (Gibco, Burlington, ON, Canada) as the solidifying agent, without the additional $MgCl_2$, for another 2-3 weeks or until the embryos become pale yellow in color. A portion of the embryos from transgenic events after varying times on gelrite are harvested to examine gene expression by RT-PCR.

Mature embryos are desiccated by transferring embryos from each event to empty Petri dish bottoms that are placed inside Magenta boxes (Sigma) containing several layers of sterile Whatman filter paper flooded with sterile water, for 100% relative humidity. The Magenta boxes are covered and maintained in darkness at 20° C. for 5-7 days. The embryos are germinated on solid B5 medium containing 2% sucrose, 0.2% gelrite and 0.075% $MgCl_2$ in Petri plates, in a chamber at 20° C., 20-h photoperiod under cool white fluorescent lights at 35-75 µmol $m^{-2} s^{-1}$. Germinated embryos with unifoliate or trifoliate leaves are planted in artificial soil (Sunshine Mix No. 3, SunGro Horticulture Inc., Bellevue, WA, USA), and covered with a transparent plastic lid to maintain high humidity. The flats are placed in a controlled growth cabinet at 26/24° C. (day/night), 18 h photoperiod at a light intensity of 150 µmol $m^{-2} s^{-1}$. At the 2-3 trifoliate stage (2-3 weeks), the plantlets with strong roots are transplanted to pots containing a 3:1:1:1 mix of ASB Original Grower Mix (a peat-based mix from Greenworld, ON, Canada):soil:sand:perlite and grown at 18-h photoperiod at a light intensity of 300-400 µmolm$^{-2} s^{-1}$.

T1 seeds are harvested and planted in soil and grown in a controlled growth cabinet at 26/24° C. (day/night), 18 h photoperiod at a light intensity of 300-400 µmol $m^{-2} s^{-1}$. Plants are grown to maturity and T2 seed is harvested. Seed yield per plant and oil content of the seeds is measured.

The selectable marker can be removed by segregation if desired by identifying co-transformed plants that have not integrated the selectable marker expression cassette and the TF gene cassette into the same locus. Plants are grown, allowed to set seed and germinated. Leaf tissue is harvested from soil grown plants and screened for the presence of the selectable marker cassette. Plants containing only the TF gene expression cassette are advanced.

Corn Transformation

An expression cassette for the TF gene can be constructed using a variety of different promoters for expression. Candidate constitutive and seed-specific promoters for use in monocots including corn are listed in TABLE 2, however those skilled in the art will understand that other promoters can be selected for expression.

Methods to transform the expression cassette into maize are routine and well known in the art and have recently been reviewed by Que et al., (2014), Frontiers in Plant Science 5, article 379, pp 1-19.

Protoplast transformation methods useful for practicing the invention are well known to those skilled in the art. Such procedures include for example the transformation of maize protoplasts as described by Rhodes and Gray (Rhodes, C. A. and D. W. Gray, *Transformation and regeneration of maize protoplasts*, in Plant Tissue Culture Manual: Supplement 7, K. Lindsey, Editor. 1997, Springer Netherlands: Dordrecht. p. 353-365). For protoplast transformation of maize, the expression cassette can be co-bombarded with an expression cassette for a selectable marker, such as the bar gene imparting transgenic plants resistance to bialophos.

For *Agrobacterium*-mediated transformation of maize, the expression cassette can be inserted into a binary vector that also contains an expression cassette for a selectable marker, such as the bar gene. The binary vector is transformed into an *Agrobacterium tumefaciens* strain, such as *A. tumefaciens* strain EHA101. *Agrobacterium*-mediated transformation of maize can be performed following a previously described procedure (Frame et al. (2006), *Agrobacterium* Protocols, Wang K., ed., Vol. 1, pp 185-199, Humana Press) as follows.

Plant Material: Plants grown in a greenhouse are used as an explant source. Ears are harvested 9-13 days after pollination and surface sterilized with 80% ethanol.

Explant Isolation, Infection and Co-Cultivation: Immature zygotic embryos (1.2-2.0 mm) are aseptically dissected from individual kernels and incubated in an *A. tumefaciens* strain EHA101 culture containing the transformation vector of interest for genome editing (grown in 5 ml N6 medium supplemented with 100 µM acetosyringone for stimulation of the bacterial vir genes for 2-5 h prior to transformation) at room temperature for 5 min. The infected embryos are transferred scutellum side up on to a co-cultivation medium (N6 agar-solidified medium containing 300 mg/l cysteine, 5 µM silver nitrate and 100 µM acetosyringone) and incubated at 20° C., in the dark for 3 d. Embryos are transferred to N6 resting medium containing 100 mg/l cefotaxime, 100 mg/l vancomycin and 5 µM silver nitrate and incubated at 28° C., in the dark for 7 d.

Callus Selection: All embryos are transferred on to the first selection medium (the resting medium described above supplemented with 1.5 mg/l bialaphos) and incubated at 28° C. in the dark for 2 weeks followed by subculture on a selection medium containing 3 mg/l bialaphos. Proliferating pieces of callus are propagated and maintained by subculture on the same medium every 2 weeks.

Plant Regeneration and Selection: Bialaphos-resistant embryogenic callus lines are transferred on to regeneration medium I (MS basal medium supplemented with 60 g/l sucrose, 1.5 mg/l bialaphos and 100 mg/l cefotaxime and solidified with 3 g/l Gelrite) and incubated at 25° C. in the dark for 2 to 3 weeks. Mature embryos formed during this period are transferred on to regeneration medium II (the same as regeneration medium I with 3 mg/l bialaphos) for germination in the light (25° C., 80-100 µmol/m$^2$/s light intensity, 16/8-h photoperiod). Regenerated plants are ready for transfer to soil within 10-14 days. Plants are grown in the greenhouse to maturity and T1 seeds are isolated.

The copy number of the transgene insert is determined, through methods such as Southern blotting or digital PCR, and lines are selected to bring forward for further analysis. Overexpression of the TF gene is determined by RT-PCR and/or Western blotting techniques and plants with the desired level of expression are selected. Homozygous lines are generated. The yield seed of homozygous lines is compared to control lines.

Rice Transformation

Candidate constitutive and seed-specific promoters for use in monocots can be used in the expression cassettes for the TF gene in rice and are listed in TABLE 2. Those skilled in the art will understand that other promoters can be selected for expression.

The example expression cassette can be used to transform the TF gene into rice. The expression cassette can be inserted into a binary vector that also contains an expression cassette for a selectable marker, such as the hygromycin selectable marker. The binary vector is transformed into an *Agrobacterium tumefaciens* AGL1 strain.

In preparation for rice transformation, callus of the rice cultivar Nipponbare is initiated from mature, dehusked, surface sterilized seeds on N6-basal salt callus induction media (N6-CI; contains per liter 3.9 g CHU ($N_6$) basal salt mix (Sigma Catalog #C1416); 10 ml of 100×N6-vitamins (contains in final volume of 500 mL, 100 mg glycine, 25 mg nicotinic acid, 25 mg pyridoxine hydrochloride and 50 mg thiamin hydrochloride); 0.1 g myo-inositol; 0.3 g casamino acid (casein hydrolysate); 2.88 g proline; 10 ml of 100×2, 4-dichlorophenoxyacetic acid (2,4-D), 30 g sucrose, pH 5.8 with 4 g gelrite or phytagel). Approximately 100 seeds are used for each transformation. The frequency of callus induction is scored after 21 days of culture in the dark at 27±1° C. Callus induction from the scutellum with a high frequency (of about 96% total callus induction) is observed.

The rice transformation vector is transformed into *Agrobacterium* strain AGL1. The resulting *Agrobacterium* strain is resuspended in 10 mL of MG/L medium (5 g tryptone, 2.4 g yeast extract, 5 g mannitol, 5 g $Mg_2SO_4$, 0.25 g $K_2HIPO_4$, 1 g glutamic acid and 1 g NaCl) to a final OD600 of 0.3. Approximately twenty-one day old scutellar embryogenic callus are cut to about 2-3 mm in size and are infected with *Agrobacterium* containing the transformation vector for 5 min. After infection, the calli are blotted dry on sterile filter papers and transferred onto co-cultivation media (N6-CC; contains per liter 3.9 g CHU ($N_6$) basal salt mix; 10 ml of 100×N6-vitamins; 0.1 g myo-inositol; 0.3 g casamino acid; 10 ml of 100×2,4-D, 30 g sucrose, 10 g glucose, pH 5.2 with 4 g gelrite or phytagel and 1 mL of acetosyringone (19.6 mg/mL stock)). Co-cultivated calli are incubated in the dark for 3 days at 25° C. After three days of co-cultivation, the calli are washed thoroughly in sterile distilled water to remove the bacteria. A final wash with a timentin solution (250 mg/L) is performed and calli are blotted dry on sterile filter paper. Callus are transferred to selection media (N6-SH; contains per liter 3.9 g CHU ($N_6$) basal salt mix, 10 ml of 100×N6-vitamins, 0.1 g myo-inositol, 0.3 g casamino acid, 2.88 g proline, 10 ml of 100×, 2,4-D, 30 g sucrose, pH 5.8 with 4 g phytagel and 500 µL of hygromycin (stock concentration: 100 mg/ml)) and incubated in the dark for two-weeks at 27±1° C. The transformed calli that survive the selection pressure and that proliferate on N6-SH medium are sub-cultured on the same media for a second round of selection. These calli are maintained under the same growth conditions for another two weeks. The number of plants regenerated after 30 days on N6-SH medium is scored and the frequency calculated. After 30 days, the proliferating calli are transferred to regeneration media (N6-RH medium; contains per liter 4.6 g MS salt mixture, 10 ml of 100×MS-vitamins (MS-vitamins contains in 500 mL final volume 250 mg nicotinic acid, 500 mg pyridoxine hydrochloride, 500 mg thiamine hydrochloride, 100 mg glycine), 0.1 g myo-inositol, 2 g casein hydrolysate, 1 ml of 1,000×1-naphtylacetic acid solution (NAA; contains in 200 mL final volume 40 mg NAA and 3 mL of 0.1 N NaOH), 20 ml of 50× kinetin (contains in 500 mL final volume 50 mg kinetin and 20 mL 0.1 N HCl), 30 g sucrose, 30 g sorbitol, pH 5.8 with 4 g phytagel and 500 µl of a 100 mg/mL hygromycin stock). The regeneration of plantlets from these calli occurs after about 4-6 weeks. Rooted plants are transferred into peat-pellets for one week to allow for hardening of the roots. The plants are then kept in sealable bags for acclimatization. Plants are transferred into pots and grown in a greenhouse to maturity.

Seed is harvested from each panicle (T1 generation) and the seed yield per plant is calculated. T1 seed is grown in a greenhouse to produce T2 seed. The mass of the total seed per plant is collected to compare seed yield of transgenics to wild-type control plants.

Camelina sativa Transformation

Constructs to overexpress the TF gene in *Camelina* can be performed as follows:

In preparation for plant transformation experiments, seeds of *Camelina sativa* germplasm 10CS0043 (abbreviated WT43, obtained from Agriculture and Agri-Food Canada) are sown directly into 4 inch (10 cm) pots filled with soil in the greenhouse. Growth conditions are maintained at 24° C. during the day and 18° C. during the night. Plants are grown until flowering. Plants with a number of unopened flower buds were used in "floral dip" transformations.

*Agrobacterium* strain GV3101 (pMP90) is transformed with the plasmid containing the expression cassette for the TF gene of interest using electroporation. This expression cassette contains a promoter, operably linked to the TF gene, operably linked to a termination sequence. An expression cassette for a gene encoding a visual marker, such as DsRed, a red fluorescent protein from the Discoma genus of coral (Matz et al., 1999, *Nat. Biotechnol.* 17, 969-973) can be used to screen transgenic seeds. A single colony of GV3101 (pMP90) containing the construct of interest is obtained from a freshly streaked plate and is inoculated into 5 mL LB medium. After overnight growth at 28° C., 2 mL of culture is transferred to a 500-mL flask containing 300 mL of LB and incubated overnight at 28° C. Cells are pelleted by centrifugation (4,000 rpm, 20 min), and diluted to an OD600 of ~0.8-1.0 with infiltration medium containing 5% sucrose and 0.05% (v/v) Silwet-L77 (Lehle Seeds, Round Rock, TX, USA). Plants of *Camelina sativa* germplasm 10CS0043 (abbreviated WT43; germplasm obtained from Kevin Falk at Agriculture and Agri-Food Canada) are transformed by "floral dip" using the chosen transformation construct as follows. Pots containing plants at the flowering stage are placed inside a 460 mm height vacuum desiccator (Bel-Art, Pequannock, NJ, USA). Inflorescences are immersed into the *Agrobacterium* inoculum contained in a 500-ml beaker. A vacuum (85 kPa) is applied and held for 5 min. Plants are removed from the desiccator and are covered with plastic bags in the dark for 24 h at room temperature. Plants are removed from the bags and returned to normal growth conditions within the greenhouse for seed formation (T1 generation of seed).

T1 seeds are screened by monitoring the expression of DsRed, a marker on the T-DNA allowing the identification of transgenic seeds. DsRed expression in the seed is visualized by fluorescent microscopy using a Nikon AZ100 microscope with a TRITC-HQ(RHOD)2 filter module (HQ545/30X, Q570LP, HQ610/75M) as previously described (Malik et al., 2015, Plant Biotechnology Journal, 13, 675). DsRed positive T1 seeds are planted in soil and transgenic plants are obtained. Transgenic plant lines are further confirmed using PCR with primers specific to the gene of interest.

Transformation using nanotubes or nanoparticles: Nanoparticles or nanotubes capable of delivering biomolecules to plants can also be used to practice the invention using *Camelina*, canola, corn, and soybean (for review see Cunningham, 2018, Trends Biotechnol., 36, 882).

Example 6. Modulating Expression of Transcription Factors Using CRISPR/Cas Genome Editing Mediated Promoter Replacement The expression of a transcription factor can be modulated by replacing the endogenous promoter in front of the transcription factor with a new promoter that is expressed at a higher or lower level, is expressed at a different developmental stage, and/or has a different tissue specificity. To modulate expression of the endogenous *Camelina* TF genes listed in TABLE 5, TABLE 7, and TABLE 8 in *Camelina*, CRISPR/Cas9 mediated promoter replacement can be used.

Promoter replacement requires the delivery of three elements to the plant, the sgRNAs to target the insertion site, the promoter cassette for insertion that is flanked by regions homologous to the genome insertion site, and the Cas nuclease enzyme. The flanking regions with homology to the genome insertion site enable incorporation of the promoter cassette through the plants endogenous homology directed repair mechanism. Delivery of the necessary genetic elements to enable promoter replacement can be achieved in multiple ways: by introducing a complex of the Cas9 enzyme, the synthesized sgRNAs, and the promoter cassette to be inserted (called ribonucleoprotein complexes, or RNPs) (FIG. 4C) directly to protoplasts (Woo et al., Nature Biotechnology, 2015, 33, 1162-1164); by transfection of protoplasts either stably or transiently with a genetic construct(s) containing expression cassettes for DNA encoding the sgRNA(s) and the Cas9 enzyme, mixed with a DNA fragment containing the promoter to be inserted (FIG. 4B); through particle bombardment of the plant or plant tissues with a genetic construct(s) with expression cassettes for DNA encoding the sgRNA(s) and the Cas9 enzyme, mixed with a DNA fragment containing the promoter to be inserted (FIG. 4B); or through *Agrobacterium*-mediated transformation of the plant or plant tissues using a binary construct(s) with expression cassettes for DNA encoding the sgRNA(s), the Cas9 enzyme, and the promoter DNA fragment to be inserted (FIG. 4B). For *Agrobacterium*-mediated transformation, it is advantageous to have the promoter DNA fragment to be inserted flanked by sgRNA binding sites with adjacent PAM sequences (FIG. 4B), so that Cas9 expression can release the promoter fragment from the vector as it enters the plant, or alternatively can release the promoter fragment from the T-DNA that is stably incorporated into the plant genome.

Alternatively, nanotube or nanoparticle mediated DNA delivery (Kwak et al., 2019, Nature Nanotechnology, DOI 10.1038/s41565-019-0375-4) (Demirer et al, 2019, Nature Nanotechnology, DOI 10.1038/s41565-019-0382-5) can be used to deliver genetic construct(s) with expression cassettes for DNA encoding the sgRNA(s) and the Cas9 enzyme, mixed with a DNA fragment containing the promoter to be inserted (FIG. 4B).

Nanoparticles or nanotubes capable of delivering biomolecules to plants (for review see Cunningham, 2018, Trends Biotechnol., 36, 882) can also be used to deliver RNPs (FIG. 4C).

An advantage of RNPs, as well as the protoplast, particle bombardment, or nanotube and nanoparticle methods, with only transient expression of the expression cassettes encoding the Cas9 enzyme and the sgRNAs, is that DNA does not stably integrate into the genome and thus does not need to be removed through segregation to produce a plant containing only the edit. For stable transformation methods, segregation of the unwanted DNA encoding the CRISPR editing machinery must be removed after the edit is obtained by conventional breeding methods. The design of each genetic component to achieve promoter replacement is described below.

Design of single guide RNAs (sgRNAs): The region around the promoter to be replaced in the genome is scanned for protospacer adjacent motif (PAM) sites, sites necessary for Cas9 to bind and cleave the target sequence. These PAM sites flank the 3' region of the double stranded DNA cut site for the Cas9 enzyme (FIG. 3C).

Figure 3:
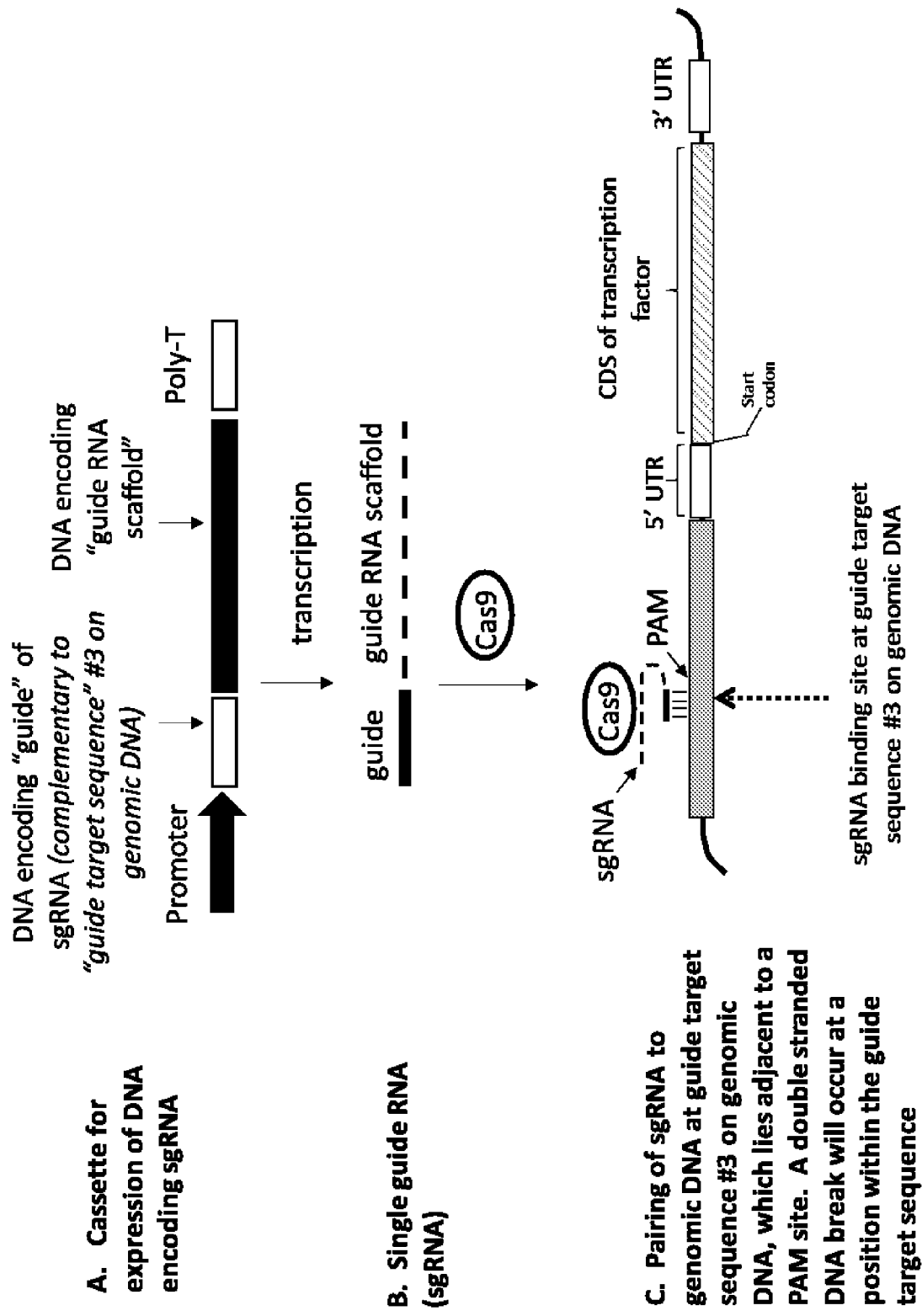
FIG. 3 illustrates genetic components at different stages of the Cas enzyme mediated genome editing process using the Cas9 enzyme as an example. Delivery of the genetic components can be achieved in multiple ways. Genetic transformation can be used to deliver the expression construct depicted in (A) into a plant cell. Transcription of (A) will produce the single guide RNA (sgRNA) depicted in (B). The sgRNA will complex with the Cas9 enzyme (that is delivered separately through genetic transformation or other means) and achieve the structure depicted in (C) to promote cleavage of the target genomic DNA at the "guide target sequence". Alternatively, the sgRNA (B) can be synthesized in vitro and introduced into cells, often in the form of Ribonucleoprotein complexes (RNPs) that contain Cas9 protein to produce the structure depicted in (C) to promote cleavage of the target genomic DNA at the "guide target sequence". When using plant transformation techniques, the expression cassette (A) for production of the sgRNA is composed of a promoter, often a plant RNA polymerase III promoter, DNA encoding the "guide" of the sgRNA, DNA encoding a "guide RNA scaffold" (gRNA Sc), and a poly T-termination signal. The combination of the "guide" and the "guide RNA scaffold" are necessary to form a functional sgRNA. The DNA encoding the guide portion of the sgRNA in (A) is often identical to the "guide target sequence" of the genomic DNA to be cut in (C), however several mismatches, depending on their position, can be tolerated and still promote double stranded DNA cleavage. The guide portion of the sgRNA pairs with this complementary DNA sequence to be mutated (referred to as guide target sequence #3 in figure) that is adjacent to a 3' protospacer adjacent motif (PAM) (C), an additional requirement for target recognition, and double stranded DNA cleavage occurs. When using the Cas9 enzyme for cleavage, all guide target sequences are typically ~20-nucleotides adjacent to a 3' PAM sequence of (NGG) to initiate cleavage by the Cas9 enzyme. When using the Cpf1 enzyme for cleavage, guide target sequences are typically ~23 nucleotides adjacent to a 5' PAM sequence that varies with the specific enzyme.

From the ~20 nucleotides of DNA sequence upstream from the PAM site, the sequence of the complementary "guide" can be obtained (FIG. 3C). To generate the functional sgRNA sequence, the sequence of the "guide" is combined with the sequence of a guide RNA scaffold (FIG. 3B). Guide RNA scaffolds have been previously described by other researchers (see for example Mali et al. 2013, Science, 339, pp. 823-826; Li et al. 2013, Nature biotechnology, 31, pp. 688-691; Konermann et al., 2015, Nature, 517, p. 583; Jiang et al., 2013, Nucleic acids research, 41, pp. e188-e188) and are well known in the art. The double stranded DNA sequence (FIG. 3A) required to generate the functional sgRNA (FIG. 3B) can be determined from the sequence of the sgRNA and used in a genetic transformation construct.

Ideally, the sequence of the DNA encoding the "guide" (FIG. 3A) is identical to the genomic DNA sequence, or "guide target sequence", that is base paired to the sgRNA (FIG. 3C). In practice, some mismatches between the sequence of the DNA encoding the guide (FIG. 3A) and the genomic DNA sequence can be tolerated and still result in double stranded cleavage by Cas9.

DNA encoding the guides (FIG. 3A) necessary to generate sgRNAs (FIG. 3B) to excise promoter regions from the plant genome are designed by identifying promoter regions upstream of the start codon and the 5'UTR of each ortholog. For this purpose, it is useful to target sequence before the ATG of the coding sequence (CDS) that includes 1000-1200 bp of sequence upstream of the 5'UTR (FIG. 4A). Verification that the specific sequence contains a predicted promoter can be performed using the RegSite Plant DB from Softberry Inc. (website: softberry.com/berry.phtml?topic=index&group=programs&subgroup=promoter) or similar programs.

DNA sequences that are ~20 nucleotides in length and span different regions of the upstream promoter (FIG. 4A) can be chosen as Guide Target Sequences. When fused to DNA encoding the guide RNA scaffold (gRNA Sc) (FIG. 3A), the transcribed product is a functional sgRNA (FIG. 3B) that has all the elements to bind with the complementary target genomic DNA that lies adjacent to a PAM sequence (FIG. 3C) and to interact with the CAS enzyme. The use of two sgRNAs, such as Guide #1 and Guide #3 in FIG. 4A, can allow for targeted excision of a region of the endogenous promoter, which can be the core base elements of the promoter, for example the −10 and −35 regions, or can include a large fragment encompassing the entire promoter region and untranslated regions. Alternatively, the use of a single sgRNA to promote site specific cleavage of DNA within one region of the endogenous promoter can be used. DNA sequences encoding the guide portion of sgRNA are designed following the SpCas9 guide RNA architectures (equivalent to 20 nucleotides of the target genomic DNA that is adjacent to a PAM sequence of NGG) using a web-based guide RNA design tool, CRISPOR, on the TEFOR website. A number of other web-based tools can also be used for guide sequence selection and analysis, such as CRISPRdirect and CRISPR-P 2.0 (Ding et al., 2016, Frontiers in Plant Science, 7, 703; Naito et al., 2015, Bioinformatics, 31, 1120; Liu et al., 2017, Molecular Plant, 10, 530). Based on the disclosure herein, it will be apparent to a person of skill in the art that different sgRNAs to target different regions of the endogenous promoter for promoter insertion or replacement can be used to modulate the expression of the endogenous TF genes in TABLE 5, TABLE 7, and TABLE 8.

To modulate expression of endogenous TF genes that are orthologs of the *Camelina* genes listed in TABLE 5, TABLE 7, and TABLE 8 in other crops, such as corn, canola, and soybean, CRISPR/Cas9 mediated promoter replacement strategies similar to those described above can be used.

Example 7. Modulating Expression of Transcription Factors Using CRISPR/Cas Genome Editing Mediated Cassette Insertion The expression of an endogenous TF gene in a crop can also be modulated by insertion of other genetic elements. For example, an expression cassette for a second copy of the TF gene can be inserted into a site within the plant genome (FIG. 5Bi).

Insertions into or near the endogenous promoter of a TF can include the insertion of an intron (FIG. 5Bii) or a promoter enhancer insertion cassette (FIG. 5Biii) to modulate the endogenous promoter's activity.

The products of each of these insertions is illustrated in FIG. 5C.

Example 8. Modulating Expression of Transcription Factors Using CRISPR/Cas Mediated Mutation The guide RNA/Cas endonuclease system can be used to create frame shift mutations of any one of the TF sequences of the invention. One or more guide RNAs are used to knockout the TF genes after the Cas nuclease makes a double strand break and the error prone DNA repair pathway, non-homologous end joining, corrects the break, creating a mutation. The most likely result is a frameshift mutation that would knockout the gene. DNA encoding the guide of the sgRNA (FIG. 3A) can be designed to target the sequence of the TF gene at the desired location.

In some instances, in frame mutations in the TF gene can be obtained. This can produce a TF with weaker or stronger activity, depending on the mutation.

When targeting the promoter region, a mutation can produce a promoter with increased strength, decreased strength, or it can lead to an inactive promoter, depending on the mutation and its location. Experiments to characterize the activity of the promoter in the mutated plants can be performed to characterize the strength of the promoter.

Example 9. Preferred *Camelina sativa* Genes for Increasing Seed Yield and/or Oil Content in Oilseeds TABLE 5 and TABLE 7 list candidate genes from *Camelina sativa* to engineer to increase seed yield and/or oil content in an oilseed. Preferred genes for increasing seed yield and/or seed oil content were determined through multiple approaches including (1) finding common genes in TABLE 5 (hub genes in brown module) and TABLE 7 (genes within brown module identified from TF-pathway correlation scores), (2) examining the predicted biological processes of genes in TABLE 7 using the TF-pathway correlation scores shown in TABLE 6, and/or (3) examining the in silico expression profile of genes in TABLE 7 across 12 different tissues using the *Camelina* eFP Browser (website: //bar.utoronto.ca/efp_camelina/cgi-bin/efpWeb.cgi). The list of genes was further reduced by only including genes that had not been previously associated with increased seed yield and/or oil content. Based on these analyses, four preferred genes, LBD42 (SEQ ID NO: 238), PEI1 (SEQ ID NO: 239), DOF4.4 (SEQ ID NO: 240), and ARR21 (SEQ ID NO: 241), were identified for engineering into oilseeds (TABLE 9).

TABLE 9

Preferred genes for engineering into oilseeds to increase seed yield and/or oil content

| Gene Name | Csa locus | Gene SEQ ID NO | Encoded protein SEQ ID NO |
|---|---|---|---|
| LBD42* | Csa16g028530 | SEQ ID NO: 238 | SEQ ID NO: 27 |
| PEI1(also known as ATTZF6) | Csa13g009540 | SEQ ID NO: 239 | SEQ ID NO: 204 |
| DOF4.4* | Csa10g022470 | SEQ ID NO: 240 | SEQ ID NO: 10 |
| ARR21* | Csa20g009570 | SEQ ID NO: 241 | SEQ ID NO: 19 |

*Genes common in TABLE 5 (Hub genes) and TABLE 7 (genes identified through TF-pathway correlation scores).

Three of these preferred genes, LBD42, DOF4.4, and ARR21, were identified as Hub genes (TABLE 5) in the co-expression network.

Figure 7:
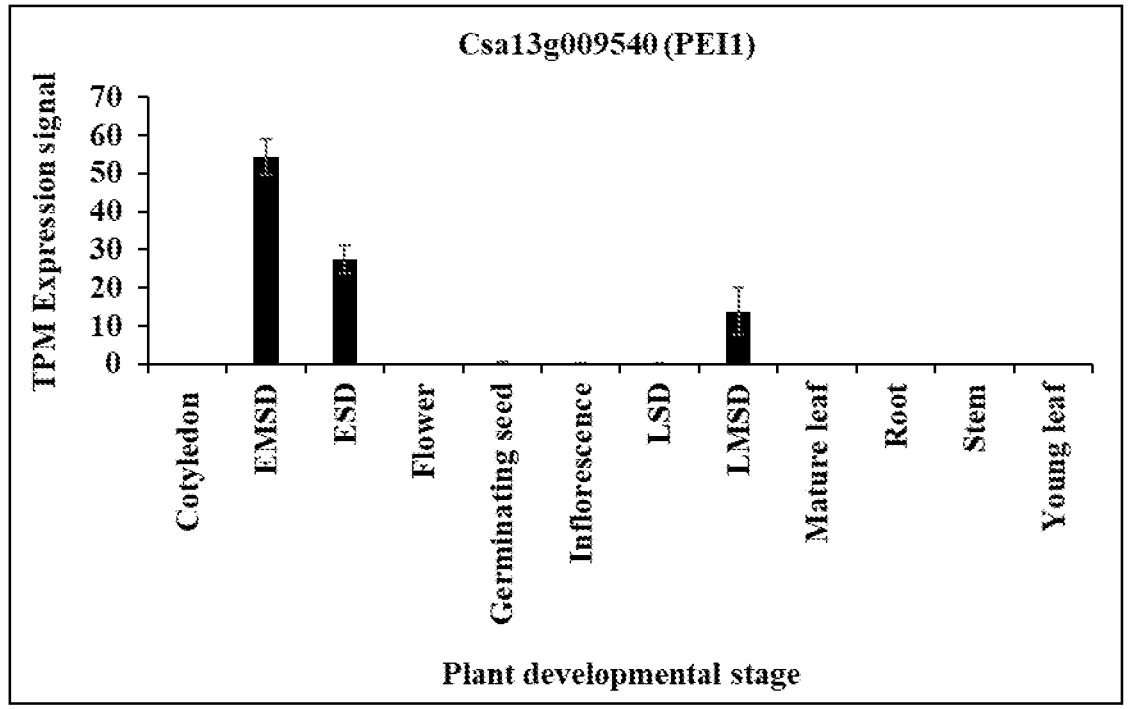
Figure 8:
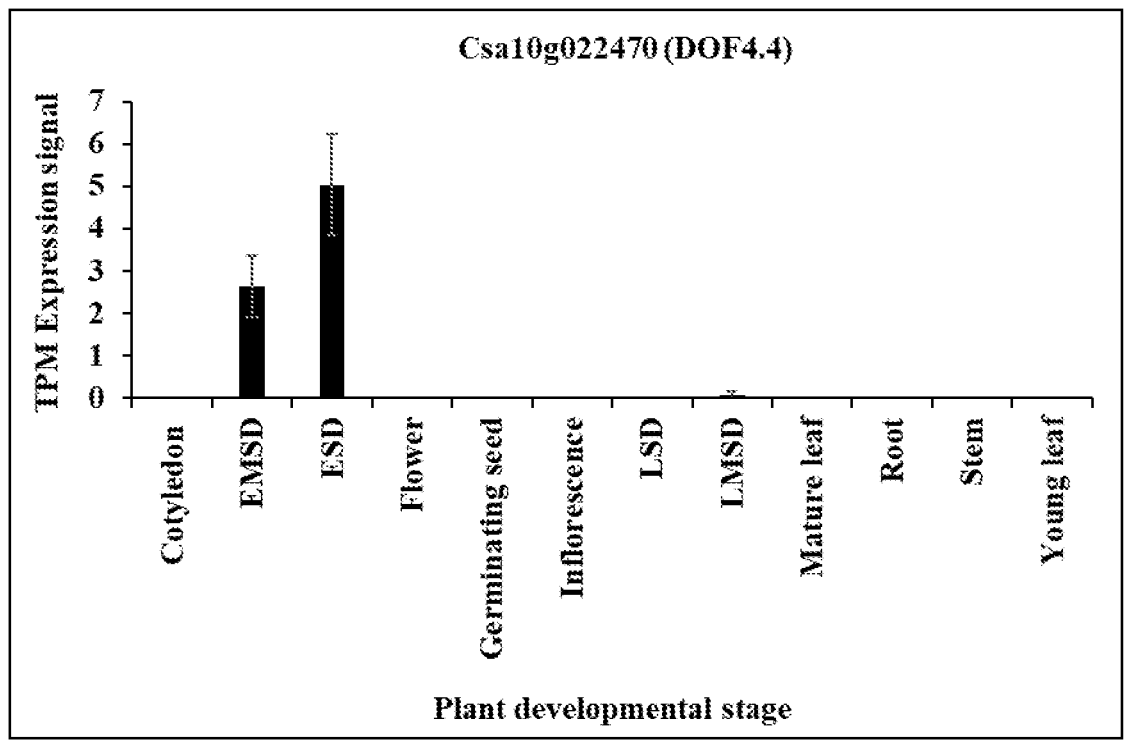
Figure 9:
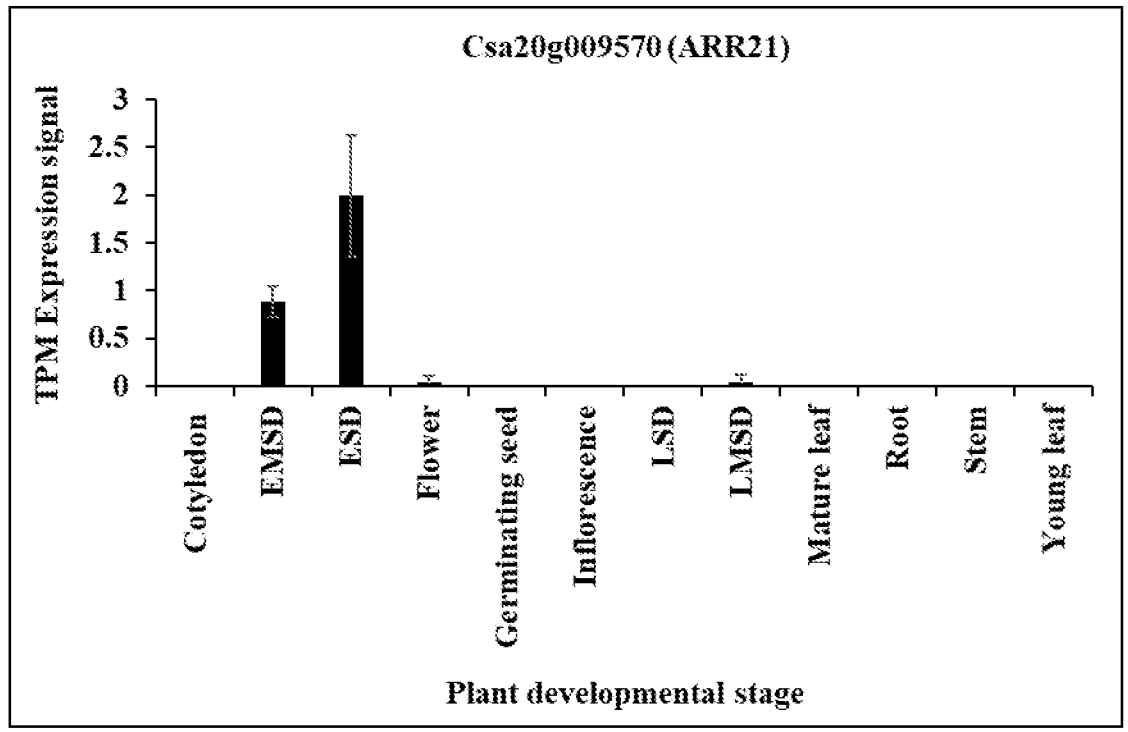

The remaining preferred gene, PEI1, is not a hub gene. PEI1 was included in the list of preferred genes due to (1) its high correlation to pathways that influence seed yield and/or oil content (TABLE 6), (2) its strong expression at early, mid, and late seed developmental stages (FIG. 7), and (3) the unique regulation of target genes by PEI1 as predicted by PlantRegMap (website: //plantregmap.cbi.pku.edu.cn/). PEI1 protein from *Arabidopsis thaliana* has been described as an embryo-specific transcription factor required at the globular to heart stage transition in embryo development (Li, 1998, *The Plant Cell*, 10, 383-398). *Arabidopsis thaliana* plants lacking PEI1 produce white seeds in which embryo development does not progress through the heart stage (Li, 1998, The Plant Cell, 10, 383-398).

The in silico expression profiles of the four preferred genes from *Camelina sativa* are shown in FIGS. 6-9.

Orthologs of the four preferred *Camelina sativa* genes in *Arabidopsis thaliana*, maize, soybean, canola, and rice are listed in TABLES 10-14. The corresponding genes of these orthologs in *Arabidopsis thaliana*, maize, soybean, canola, and/or rice also may be engineered to increase seed yield and/or oil content in an oilseed.

TABLE 10

Orthologs of preferred *Camelina sativa* genes in *Arabidopsis thaliana*

| Gene Name | Csa locus | Protein SEQ ID NO | *Arabidopsis thaliana* locus (accession) | Protein SEQ ID NO | Sequence identity (%) |
|---|---|---|---|---|---|
| LBD42* | Csa16g028530 | SEQ ID NO: 27 | Q9CA30.1 | SEQ ID NO: 311 | 95.71% |
| PEI1(also known as ATTZF6) | Csa13g009540 | SEQ ID NO: 204 | O65036.1 | SEQ ID NO: 312 | 89.34% |
| DOF4.4* | Csa10g022470 | SEQ ID NO: 10 | Q9SUA9.1 | SEQ ID NO: 313 | 47.80% |
| ARR21* | Csa20g009570 | SEQ ID NO: 19 | Q9LYP5.3 | SEQ ID NO: 314 | 72.76% |

TABLE 11

Orthologs of preferred *Camelina sativa* genes in maize

| Gene Name | Csa locus | Protein SEQ ID NO | Maize locus (accession) | Protein SEQ ID NO | Sequence identity (%) |
|---|---|---|---|---|---|
| LBD42* | Csa16g028530 | SEQ ID NO: 27 | — | — | — |
| PEI1(also known as ATTZF6) | Csa13g009540 | SEQ ID NO: 204 | AFT82650.1 | SEQ ID NO: 315 | 42.92% |
| DOF4.4* | Csa10g022470 | SEQ ID NO: 10 | AFT82704.1 | SEQ ID NO: 316 | 39.15% |
| ARR21* | Csa20g009570 | SEQ ID NO: 19 | AFU81650.1 | SEQ ID NO: 317 | 22.75% |

TABLE 12

Orthologs of preferred *Camelina sativa* genes in soybean

| Gene Name | Csa locus | Protein SEQ ID NO | Soybean locus (accession) | Protein SEQ ID NO | Sequence identity (%) |
|---|---|---|---|---|---|
| LBD42* | Csa16g028530 | SEQ ID NO: 27 | XP_003541285.1 | SEQ ID NO: 318 | 55.20% |
| PEI1(also known as ATTZF6) | Csa13g009540 | SEQ ID NO: 204 | XP_003544707.1 | SEQ ID NO: 319 | 37.61% |
| DOF4.4* | Csa10g022470 | SEQ ID NO: 10 | XP_006594581.1 | SEQ ID NO: 320 | 38.30% |
| ARR21* | Csa20g009570 | SEQ ID NO: 19 | XP_014624277.1 | SEQ ID NO: 321 | 31.21% |

TABLE 13

Orthologs of preferred *Camelina sativa* genes in canola

| Gene Name | Csa locus | Protein SEQ ID NO | Canola locus (accession) | Protein SEQ ID NO | Sequence identity (%) |
|---|---|---|---|---|---|
| LBD42* | Csa16g028530 | SEQ ID NO: 27 | XP_013702916.1 | SEQ ID NO: 322 | 89.74% |
| PEI1(also known as ATTZF6) | Csa13g009540 | SEQ ID NO: 204 | XP_013743197.1 | SEQ ID NO: 323 | 81.48% |
| DOF4.4* | Csa10g022470 | SEQ ID NO: 10 | XP_013717421.1 | SEQ ID NO: 324 | 55.31% |
| ARR21* | Csa20g009570 | SEQ ID NO: 19 | CDY67763.1 | SEQ ID NO: 325 | 63.80% |

TABLE 14

Orthologs of preferred *Camelina sativa* genes in rice

| Gene Name | Csa locus | Protein SEQ ID NO | Rice locus (accession) | Protein SEQ ID NO | Sequence identity (%) |
|---|---|---|---|---|---|
| LBD42* | Csa16g028530 | SEQ ID NO: 27 | EEE54673.1 | SEQ ID NO: 326 | 54.50% |
| PEI1(also known as ATTZF6) | Csa13g009540 | SEQ ID NO: 204 | XP_015640763.1 | SEQ ID NO: 327 | 41.67% |
| DOF4.4* | Csa10g022470 | SEQ ID NO: 10 | XP_015623741.1 | SEQ ID NO: 328 | 32.00% |
| ARR21* | Csa20g009570 | SEQ ID NO: 19 | XP_015630577.1 | SEQ ID NO: 329 | 28.60% |

Example 10. Transformation of *Camelina sativa* and Canola with Preferred Genes for Increasing Seed Yield and/or Oil Content Listed in TABLE 9

Expression cassettes for each gene listed in TABLE 9 can be prepared for transforming *Camelina sativa* and/or canola by choosing a suitable promoter and termination sequence. Suitable promoters, including constitutive and seed-specific promoters, are listed in TABLE 1. Preferred constitutive expression cassettes contain the constitutive CaMV 35S promoter (SEQ ID NO: 206) operably linked to the gene of interest (LBD42, PEI1, DOF4.4, or ARR21) operably linked to a suitable termination sequence. Preferred seed-specific expression cassettes contain the oleosin promoter from *Glycine max* (SEQ ID NO: 216) operably linked to the gene of interest (LBD42, PEI1, DOF4.4, or ARR21) operably linked to a suitable termination sequence. These expression cassettes can be inserted into a binary vector and transformed into canola or *Camelina* using *Agrobacterium*-mediated transformation as described above. Alternatively, the isolated expression cassettes can be transformed into canola or *Camelina* using particle bombardment procedures.

Example 11. Additional Transcription Factors in the Co-Expression Network Brown Module Two hundred and eleven transcription factors were identified in the brown module described in Example 2. A subset of these 211 transcription factors were listed in TABLE 5, TABLE 7, and TABLE 8. The remaining 69 transcription factors are listed in TABLE 15. These 69 TFs can be used to engineer *Camelina*, or other oilseeds such as canola, to increase seed yield and/or oil content as previously described above.

TABLE 15

Additional candidate transcription factor(s) from brown module to increase seed yield and/or oil content

| Csa locus | C. sativa gene description | NCBI ID | A. thaliana gene | A. thaliana BLAST hit |
|---|---|---|---|---|
| Csa01g018100 SEQ ID NO: 242 | NAC transcription factor 56 | XP_010503061.1 | NAC056 | AT3G15510 |
| Csa02g061860 SEQ ID NO: 243 | AP2-like ethylene-responsive transcription factor AIL5 | XP_010452060.1 | AIL5 | AT5G57390 |
| Csa02g068390 SEQ ID NO: 244 | NAC domain-containing protein 100-like | XP_010457328.1 | NAC100 | AT5G61430 |
| Csa02g073440 SEQ ID NO: 245 | transcription factor TGA1, transcript variant X1 | XP_010462108.1 | TGA1 | AT5G65210 |
| Csa03g020230 SEQ ID NO: 246 | myb-related protein Myb4-like, transcript variant X2 | XP_010497901.1 | MYB4 | AT1G16490 |
| Csa04g044320 SEQ ID NO: 247 | transcription factor bHLH60-like | XP_010504720.1 | BHLH60 | AT3G57800 |
| Csa04g049030 SEQ ID NO: 248 | uncharacterized LOC104781971, transcript variant X3 | XP_010505080.1 | Homeodomain-like | AT2G35640 |
| Csa04g055500 SEQ ID NO: 249 | ABSCISIC ACID-INSENSITIVE 5-like protein 3 | XP_010505871.1 | DPBF4 | AT2G41070 |
| Csa04g057930 SEQ ID NO: 250 | basic leucine zipper 34-like | XP_019100580.1 | BZIP34 | AT2G42380 |
| Csa04g058020 SEQ ID NO: 251 | LOB domain-containing protein 16 | XP_010506068.1 | LBD16 | AT2G42430 |
| Csa04g062780 SEQ ID NO: 252 | homeobox-leucine zipper protein ATHB-4-like | XP_010506430.1 | ATHB-4 | AT2G44910 |
| Csa05g003640 SEQ ID NO: 253 | agamous-like MADS-box protein AGL6 | XP_010508132.1 | AGL6 | AT2G45650 |
| Csa05g003860 SEQ ID NO: 254 | LOB domain-containing protein 18 | XP_010508173.1 | LBD18 | AT2G45420 |
| Csa05g004360 SEQ ID NO: 255 | homeobox-leucine zipper protein ATHB-4-like | XP_010508231.1 | ATHB-4 | AT2G44910 |
| Csa05g009160 SEQ ID NO: 256 | LOB domain-containing protein 16-like | XP_010508576.1 | LBD16 | AT2G42430 |
| Csa05g011590 SEQ ID NO: 257 | ABSCISIC ACID-INSENSITIVE 5-like protein 3 | XP_010508770.1 | DPBF4 | AT2G41070 |
| Csa05g017650 SEQ ID NO: 258 | growth-regulating factor 3-like | XP_010509475.1 | GRF3 | AT2G36400 |
| Csa05g021350 SEQ ID NO: 259 | WUSCHEL-related homeobox 9 | XP_019082947.1 | WOX9 | AT2G33880 |
| Csa05g022930 SEQ ID NO: 260 | NAC domain-containing protein 41 isoform X1 | XP_010413856.1 | NAC | AT2G33480 |
| Csa05g072040 SEQ ID NO: 261 | transcription factor MYB114-like | XP_010511463.1 | MYB90 | AT1G66390 |
| Csa05g079950 SEQ ID NO: 262 | LOB domain-containing protein 40 | XP_010511626.1 | LBD40 | AT1G67100 |
| Csa06g029500 SEQ ID NO: 263 | AP2-like ethylene-responsive transcription factor SMZ | XP_010516049.1 | AP2 | AT3G54990 |
| Csa06g039040 SEQ ID NO: 264 | growth-regulating factor 3 | XP_010516861.1 | GRF3 | AT2G36400 |
| Csa06g046960 SEQ ID NO: 265 | ABSCISIC ACID-INSENSITIVE 5-like protein 3 | XP_010517591.1 | DPBF4 | AT2G41070 |

TABLE 15-continued

Additional candidate transcription factor(s) from brown module to increase seed yield and/or oil content

| Csa locus | C. sativa gene description | NCBI ID | A. thaliana gene | A. thaliana BLAST hit |
|---|---|---|---|---|
| Csa06g048530 SEQ ID NO: 266 | LOB domain-containing protein 16-like | XP_010517768.1 | LBD16 | AT2G42430 |
| Csa07g007900 SEQ ID NO: 267 | NAC domain-containing protein 41, transcript variant X1 | XP_010413857.1 | NAC041 | AT2G33480 |
| Csa07g032410 SEQ ID NO: 268 | LOB domain-containing protein 40-like isoform X2 | XP_010415261.1 | LOB | AT1G67100 |
| Csa07g065130 SEQ ID NO: 269 | transcription factor EGL1-like, transcript variant X3 | XP_010418394.1 | BHLH2 | AT1G63650 |
| Csa08g005750 SEQ ID NO: 270 | agamous-like MADS-box protein AGL15 | XP_010419983.1 | AGL15 | AT5G13790 |
| Csa08g009490 SEQ ID NO: 271 | homeobox-leucine zipper protein HDG9-like | XP_010420445.1 | HDG9 | AT5G17320 |
| Csa08g009620 SEQ ID NO: 272 | AP2-like ethylene-responsive transcription factor BBM | XP_010420464.1 | BBM | AT5G17430 |
| Csa08g011090 SEQ ID NO: 273 | zinc finger CCCH domain-containing protein 58-like | XP_010420624.1 | Zinc finger | AT5G18550 |
| Csa08g054010 SEQ ID NO: 274 | AP2-like ethylene-responsive transcription factor AIL6 | XP_010422835.1 | AP2 | AT5G10510 |
| Csa08g056890 SEQ ID NO: 275 | zinc finger CCCH domain-containing protein 54 | XP_010423197.1 | Zinc finger | AT5G07500 |
| Csa09g065810 SEQ ID NO: 276 | AP2-like ethylene-responsive transcription factor SMZ | XP_010427236.1 | SMZ | AT3G54990 |
| Csa09g071410 SEQ ID NO: 277 | agamous-like MADS-box protein AGL1 [Camelina sativa] | XP_010427788.1 | AGL1 | AT3G58780 |
| Csa09g072570 SEQ ID NO: 278 | uncharacterized protein LOC104712692 isoform X1 | XP_019085743.1 | BHLH160 | AT1G71200 |
| Csa10g003940 SEQ ID NO: 279 | transcription factor SPATULA-like, transcript variant X2 | XP_010432082.1 | SPT | AT4G36930 |
| Csa10g008930 SEQ ID NO: 280 | B3 domain-containing protein REM16-like isoform X1 | XP_010432581.1 | B3 | AT4G33280 |
| Csa10g011420 SEQ ID NO: 281 | ethylene-responsive transcription factor ERF015-like | XP_010436316.1 | ERF015 | AT4G31060 |
| Csa10g017470 SEQ ID NO: 282 | dehydration-responsive element-binding protein 1A-like | XP_010433631.1 | DREB1A | AT4G25480 |
| Csa11g004450 SEQ ID NO: 283 | transcription factor SPATULA-like, transcript variant X2 | XP_010437251.1 | SPT | AT4G36930 |
| Csa11g065270 SEQ ID NO: 284 | transcription factor bHLH71-like | XP_010441558.1 | BHLH71 | AT5G46690 |
| Csa11g090950 SEQ ID NO: 285 | AP2-like ethylene-responsive transcription factor AIL5 | XP_010443425.1 | AIL5 | AT5G57390 |
| Csa11g102430 SEQ ID NO: 286 | transcription factor TGA1-like, transcript variant X3 | XP_010462108.1 | TGA1 | AT5G65210 |
| Csa11g102460 SEQ ID NO: 287 | dof zinc finger protein DOF5.7 | XP_010444508.1 | DOF5.7 | AT5G65590 |
| Csa12g004200 SEQ ID NO: 288 | transcription factor SPATULA-like, transcript variant X2 | XP_019088981.1 | SPT | AT4G36930 |
| Csa12g007960 SEQ ID NO: 289 | protein RKD5-like | XP_019089344.1 | RKD5 | AT4G35590 |

TABLE 15-continued

Additional candidate transcription factor(s) from brown module to increase seed yield and/or oil content

| Csa locus | C. sativa gene description | NCBI ID | A. thaliana gene | A. thaliana BLAST hit |
|---|---|---|---|---|
| Csa12g011520 SEQ ID NO: 290 | B3 domain-containing protein REM16-like | XP_019089716.1 | REM16 | AT4G33280 |
| Csa12g016010 SEQ ID NO: 291 | ethylene-responsive transcription factor ERF015-like | XP_010451100.1 | ERF015 | AT4G31060 |
| Csa13g012280 SEQ ID NO: 292 | AP2-like ethylene-responsive transcription factor AIL6 | XP_010453080.1 | AP2 | AT5G10510 |
| Csa13g017580 SEQ ID NO: 293 | transcription factor WER-like | XP_019084715.1 | WER | AT5G14750 |
| Csa13g020200 SEQ ID NO: 294 | AP2-like ethylene-responsive transcription factor BBM | XP_010453937.1 | BBM | AT5G17430 |
| Csa13g020630 SEQ ID NO: 295 | WUSCHEL-related homeobox 12-like | XP_010453983.1 | WOX12 | AT5G17810 |
| Csa14g027760 SEQ ID NO: 296 | agamous-like MADS-box protein AGL80 isoform X1 | XP_010498732.1 | AGL80 | AT1G22590 |
| Csa14g032030 SEQ ID NO: 297 | B3 domain-containing protein REM17-like | XP_010460279.1 | REM17 | AT1G26680 |
| Csa15g003920 SEQ ID NO: 298 | myb-related protein 2, transcript variant X2 | XP_010463875.1 | MYR2 | AT3G04030 |
| Csa16g026870 SEQ ID NO: 299 | LOB domain-containing protein 40-like | XP_010470605.1 | LBD40 | AT1G67100 |
| Csa17g071560 SEQ ID NO: 300 | ethylene-responsive transcription factor RAP2-1-like | XP_010479108.1 | RAP2-1 | AT1G46768 |
| Csa18g003340 SEQ ID NO: 301 | transcription factor bHLH71-like, transcript variant X1 | XP_010481425.1 | BHLH71 | AT5G46690 |
| Csa18g030400 SEQ ID NO: 302 | AP2-like ethylene-responsive transcription factor AIL5 | XP_010483252.1 | AIL5 | AT5G57390 |
| Csa19g022280 SEQ ID NO: 303 | NAC transcription factor 56-like | XP_010465520.1 | NAC056 | AT3G15510 |
| Csa20g010110 SEQ ID NO: 304 | NAC domain-containing protein 79-like [Camelina sativa] | XP_010491387.1 | NAC79 | AT5G07680 |
| Csa20g015840 SEQ ID NO: 305 | AP2-like ethylene-responsive transcription factor AIL6 | XP_010491724.1 | AIL6 | AT5G10510 |
| Csa20g021290 SEQ ID NO: 306 | transcription factor WER-like, transcript variant X2 | XP_010492291.1 | WER | AT5G14750 |
| Csa20g025580 SEQ ID NO: 307 | AP2-like ethylene-responsive transcription factor BBM | XP_010492696.1 | BBM | AT5G17430 |
| Csa20g026000 SEQ ID NO: 308 | WUSCHEL-related homeobox 12-like | XP_010492747.1 | WOX12 | AT5G17810 |
| Csa20g026430 SEQ ID NO: 309 | B3 domain-containing protein At5g18090-like | XP_010492802.1 | B3 | AT5G18090 |
| Csa20g080840 SEQ ID NO: 310 | transcription factor bHLH71 | XP_010494850.1 | BHLH71 | AT5G46690 |

Reference to a "Sequence Listing," a Table, or a Computer Program Listing Appendix Submitted as an ASCII Text File The material in the ASCII text file, named "YTEN-60942WO-Sequence-Listing_ST25.txt", created May 12, 2020, file size of 929,792 bytes, is hereby incorporated by reference.

SEQUENCE LISTING (329 sequences)

SEQ ID NO: 1 - protein, 480 aa, Camelina sativa
MKRRLTSTNSSSSSPSSSVSSSTTTSSPIQSETPRPKRANKRAKKPSPSDDKTTNPTSPASTRRSSIYRGVTRHRWTGRFEAHLWDKSSWNSIQNKKGKQGLFDSFILLMFDLNFVTAPSAISSSTHQFIWRRGVDLVRRRISTASRVIAGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVSQANHQEEAILAEAKQEIEAKEEPTEEVKQQCVEEPPQVQKEEKAEQQGEEVVGYKEEEAAVVNCCIDSSAIMEMNRCSDDNELAWNFCMMDSGFTPFLTDQNLSNENPIEYPELFNELAFEENIDFMFEEGKNECLGLGNLDCCEVVVGRESPTSSSSPLSCFSTDSASSTTTTTATTTSVSCNYSV

SEQ ID NO: 2 - protein, 335 aa, Camelina sativa
MNPNLLEKDLRGNEPINGLRRFEDANNFGSLPNSHTTASRKTSLTNLSLSRNHPHNKSASALEPEDEHEKEKGENEKSLRMRGKSGINTKLCSRGHWRPTEDAKLKELVAQFGPQNWNLIAHHLLGRSGKSCRLRWFNQLDPRINKRAFTEEEECRLLAAHQAYGNKWAMISRLFPGRTDNAVKNHWHVIMARRTRESQRQRQQPPPTPSRDAEMAVSSSCRYNHEEFFGNVAKGSFVNEEDDEDDDDGSAVSTCTTELSLTPPSSAYHPRFLNYDKTLASGKDGQCVQRAEVNGIYGKKMDHQNHHTISVSERKVEMKMKSGFYFFDFLGVGAS

SEQ ID NO: 3 - protein, 431 aa, Camelina sativa
MKRRLTSTNSSSSSPSSSVSSSTTTSSPIQSETPRPKRANKRAKKPSPSGDKPNNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVYPFPVSQANHQEEAILAEAKQEIEAKEEPTEEVKQQYVEEPPQQVQKEEKAEQQGEEFVAYKEEEAAVVNCCIDSSAIMGMNRCSDDNELAWNFCMMDSGFAPFLTDQNLPNENPIEYPELFNELAFEENIDFMFEEGKNEYLGLGNLDCCDVVVVGRESPTSSSSPLSCFSTDSASSSTTTTSVSCNYSV

SEQ ID NO: 4 - protein, 467 aa, Camelina sativa
MKRRLTSTNSSSSSPSSSVSSSTTTSSPIQSETPRPKRANKRAKKPSPSDDKPNNPTSPASTRRSSIYRGVTRHRWTGRFEAHLWDKSSWNSIQNKKGKQDQFLGFTKLKKKERERGWIWSEERISTASPVIAGAYDSEEAAAHTYDLAALKYWGPDTILNFPAKQAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVSQANHQEEAILAEAKQEIEAKEEPTEEVKQQCVEEPPQVQKEEKAEQQGEEFVGYNKEEEATVVNCSIDSSAIMEMNRCSDDNELAWNFCMMDSGFAPFLTDQNLSNENPIEYPELFNELAFEENIDFMFEEGKNECLGLGNMDCCDVVVVGRESPTSSSSPLSCFSTDSASSTTTATTTTSVSCNYSV

SEQ ID NO: 5 - protein, 198 aa, Camelina sativa
MRNTPTTRRSSVRRRLTPEPEPAVKKFIKIINLSTIKENMMKIPERFVRLGPKLTDNVTLETPVGFKRSIRIKRIGNEVWFEKGWSEFAEAHSLSEGHFLFFHYKGKSSFSVVIFDVTASEIEYPLDKVYVIESNDDDDKEEVMEVMDDDDEQGFAGFESSESEEVIELDELLNKKKRKESALSLRNLQHFDNVEEVD

SEQ ID NO: 6 - protein, 335 aa, Camelina sativa
MNPNLLEKDLRGNEPINGSRRFEDANNFGSLPNSHTTASRKTSLTNLSLSRLHPHNKSASALEPEDEHEKEKGENEKSLRMRGKSGINTKVCSRGHWRPTEDAKLKELVAQFGPQNWNLIAHHLLGRSGKSCRLRWFNQLDPRINKRAFTEEEECRLLAAHQAYGNKWAMISRLFPGRTDNAVKNHWHVIMARRTRESQRQRQQPPQAPSRDAERTVSSSCRYNHEEFFGNVANGSFVNEEDDEDDDDGSAVSTCTTELSLTPPSSAYQPRFLNYDNTLASGKDGQCVQRAEVNGIYGKKMDHQNHHTISVSERKVEMKMKSGFYFFDFLGVGAS

SEQ ID NO: 7 - protein, 247 aa, Camelina sativa
MEGGASSNDVAESSKKIGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNLNRHILGESLGSLNFKELKNLESRLEKGISRVRSKKHEMLVAEIEYMQKREIELQNDNMYLRSKITERAGLQQQESGAIHQGTVYESGVTSSHHSEQYNRNYIPVNLLEPNQNSSNHDQPPLQLV

SEQ ID NO: 8 - protein, 439 aa, Camelina sativa
MEFESVIKLHYPYLAAVIYDDSLTTKDDFSCIHNVHHKPIQINLDRSHLPSMPHTHELPSKETNRGITPSPCTETFETYFHGTSNDQGFFSMAYTTSQTVESNISHVTHESTMWENDQNQGFIFGTESTFNLALVESNQFNMLKPNLSANEDTIISRCQNNQVMIKTEQVKKKNKRFQMRRICKPAKKASIIKGQWTPVEDKLLVKLVENHGTKKWSQIAKMLQGRVGKQCRERWHNHLRPDIKKDGWTEEEDIILIEAHKQIGNKWAEIARKLPGRTENMIKNHWNATKRRQHSRRAKGKDEISLQLGSNTLQNYIRSVTYKDDTLTLMTPNSNVGPKNMRDKGKGVMAAVKEDKEDECKYIVDGVMNMDLDDKRKIPSLAAVSSTCASTSGSASGSGSGVTMELNEPMTDSWMVMHGCDEVMMNEIALLEMIAHGRL

SEQ ID NO: 9 - protein, 521 aa, Camelina sativa
MDGSSIIPTEKSAGAEKRELQGLLKEAVQSVEWTYSLFWQFCPQQRVLVWGNGYYNGAIKTRKTTQPAEVTAEEATLERSQQLRELYETLLAGESTSEARACTALSPEDLTETEWFYLMCVSFSFSPPSGMPGKAYARRKHVWLSGANEVDSKTFCRAILAKSAKIQTVVCIPMLNGVVELGTTKKVKEDVEFVELVKSFFIGYSNSIPKPALSEHSTYEVHEEEEEEEAEVEEEEEEEEEEEEMTMSEEMRFGSPDDDNVSNQNLRSDLHIESTHTLDTHMDMMNLMEEGGIYSQTVTTLLMSHPTSLLSDSVSTSSYVQSSFSTWRAENVKDHQRVESQWMLKHMILRVPFLHDNTKEKSLPREDLNHVVAERRRREKLNEKFTTLRSMVPFMTKMDKVSILGDTIEYVNHLRKRVHELETTHHDKQHKRTRTCKRKTSEEVEVSIIESDVLLEMRCEYRDGLLLDILQVLHDLGIETSSVHTAVNDGDFEAEIRAKVRGKKASIVEVKRAIHQVIIHN

SEQ ID NO: 10 - protein, 211 aa, Camelina sativa
MDNVSVLAKGENQLNGEKPPPEVCARCSSNNTKFCYYNNYSMSQPRYFCKECRRYWTQGGTLRNVPVGGGCRKPKRPRIEHSSVSQVASFENQPVNHQPFRLVHENNESVGLFGGSTSSSSSPAAVAAVLGKHLGYLAEFRGVTNVPQVRGLRPVLLDRLDFVHQHKWNQSFDNTMNVNHEASSSGSRGSSDTETNSNNNNNNKDQKHLFD

SEQ ID NO: 11 - protein, 247 aa, Camelina sativa; identical to SEQ ID NO: 7

SEQ ID NO: 12 - protein, 457 aa, Camelina sativa
MNPNLLEKDLRGNEPINGSRRFEDANNFGSLPNSHTTASRKTSLTNLSLSRNHPHNKSASALEPEDEHEKEKGENAKSLRMRGKNGINTKLCSRGHWRPTEDAKLKELVAQFGPQNWNLIAHHLLGRSGKSCRLRWFNQLDPRINKRAFTEEEECRLLAAHQAYGNKWAMISRLFPGRTDNAVKNHWHVIMARRTRESQRQRQQPPQAPSRDAERTVSSSCRYNHEEFFGNVANGSFVNEEDDEDDDDGSAVSTCTTELSLTPPSSAYQPRFLNYDNTLASAHQAYGNKWAMISRLFPGRTDNAVKNHWHVIMARRTRESQRQRQQPPPTPSRDAEMAVSSSCRYNHEEFFGNVANGSFVNEEDDEDDDDGSAVSTCTTELSLTPPSSAYQPRFLNYDNTLASGKDGQCVQRAEVNGIYGKKMDHQNHHTISVSERKVEMKMKSGFYFFDFLGVGAS

SEQ ID NO: 13 - protein, 439 aa, Camelina sativa
MEFESVIKMHYPYLAAVIYDDSLTIKDDFSCIHNMHHKPIQINLDMSHLPSMPHTHEIPSKETNRGITPSPCTETFETYFHGTSNDQGFFSMAYTTSQTVESNVSHVTHESTMWENDQNQGFIFGTESTFNLALVESNQFIMPKPNLSANEDTIISRLQNNQVMIKTEQVKKNNKRFQIRRIRKPTKNASIIKGQWTPVEDKLLVKLVESHGTKKWSQIAKMLQGRVGKQCRERWHNHLRPDIKKDGWTEEEDIILIEAHKQIGNRWAEIARKLPGRTENTIKNHWNATKRRQNSRRAKGKDEVSLQLGSNTLQNYIRSVTYKDDTLTLMTPNSNVGPKNMRDKGKGVMVAVKEDEEDECKYIVDGVMNMGLDNKTKMPSLAAVSSTCASTSGSASASGSGVTMELDEPMTDSWMVMHGCDEVMMSEIALLEMIAHGRL

SEQ ID NO: 14 - protein, 507 aa, Camelina sativa
MDGSSIIPTEKSAGAEKRELQGLLKEAVQSVEWTYSLFWQFCPQQRVLVWGNGYYNGAIKTRKTTQPAEVTAEEAALERSQQLRELYQTLLAGESTSEARACTALSPEDLTETEWFYLMCVSFSFSPPSGIPGKAYARRKHVWLSGANEVDSKSFSRAILAKTVVCIPMLNGVVELGTTKKVKEDVEFVELIKSFFIGYSNSIPKPALSEHSTYEVHEEVEEEEEEEVEEEMTMSEEMRLGSPDDDDVSNQNLRSDLHIESTHTLDTNMDMMNLMEEGGIYSQTVTTLLMSHPTSLLSESVTTSSYVQSSFSTWRVENVRPSASGVAMDAQTHDLESSYNTKDKSLPREDLNHVVAERRRREKLNEKFLTLRSMVPFLTKMDKVSILGDTIEYVNHLRKRVHELETTHHEKQHKRTRTSKRKTLEEVEVSIIESDVLLEMRCEYRDGLLLDILQVLHDLGIETTSVHTAVNDGDFEAEIRAKVRGKKASIAEVKRAIHQVIIHNTNL

SEQ ID NO: 15 - protein, 249 aa, Camelina sativa
MEGGASSNDVAESSKKIGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNLNRHILGESLGSLNFKELKNLESRLEKGISRVRSKKHEMLVAEIEYMQKRVKEIELQNDNMYLRSKITERAGLQQQESGAIHQGTVYESGVTSSHHSEQYNRNYIPVNLLEPNQNSSNHDQPPLQLV

SEQ ID NO: 16 - protein, 439 aa, Camelina sativa
MEFESVIKMHYPYLAAVIYDDNLTIKDEFSCVHNMHQKPIQINLDSSHLPSMPHTHEMPSNETIRGITPSPCTETFETYFHGTSNNQGFFSMAYTTSQTVESNVSHVTHESTMWENDQNQGFIFGTESTFNLALVESNQFNMPKPNLSANEDTIISRGQNNQVMIKTEQVKKKNKRFQMRRICKPAKKASIIKGQWSPEEDKLLVKLVESHGTKKWSQIAKMLQGRVGKQCRERWHNHLRPDIKKDGWTEEEDIILIEAHKKIGNKWAEIARKLPGRTENTIKNHWNATKRRQHSRRAKGKDEISLQLGSNTLQNYIRSVTYKDDTLTLMTPNSNVGPKNMRDKGKSVMAAVKEYEEDECKYIVDGVKNMDLDDKRKMTSLTAVSSTCASTSGSASGSGSGVTMELDEPMTDSWMVMHGCDEVMMNEIALLEMIAHGRL

SEQ ID NO: 17 - protein, 369 aa, Camelina sativa
MGRHSCCYKQKLRKGLWSPEEDEKLLNHITNHGHGCWSSVPKLAGLQRCGKSCRLRWINYLRLDLKRGAFSPEEENLIVELHAVLGNRWSQIASRLPGRTDNEIKNLWNSSIKKKLKQRGIDPNTHKPISEVESFSDKDKPTTSNNNKRSGNDNKSPSSSSATNQDFFLERPSDFSDFFGFQKLNFNSNLGLSVTTDPSLCSMIPTQFSSGNMVGSVFQTPVCVKPLISLPQDNSSSPVSGGEHVKLAAPNWEFQTNNNNTSNFFDNGGGFSWSIPNSSSSSSQVKQNHNFEEIKWSEYLNTPFFIGSTVQSQSSQPIYIKSETDYLANVSNMADPWSQSQNENLGTTEASDVFSKDLQRMAVSFGQSL

SEQ ID NO: 18 - protein, 208 aa, Camelina sativa
MVTTRKTKARITSSSHGRPPQDPESPVKTFFKIILPSTMKNDMMKIPPTFVKLQGSKLPDVVTLETPVGFKRSIKLKRIGQEIWFHEGWSEFAEAHSIKEGHFLLFQYYEISSFRVIIFNVSACEIEYPRDAVHISDSDDDIIDITDERFVGTQITRGNNQSVNGGDTEHNPKKRPSDIEFDKILQDVDVISSIHVPKEEEDIRVFRG

SEQ ID NO: 19 - protein, 626 aa, Camelina sativa
MTFAESLHNKSSVLSINILVVDDDPVILEVLPKMLVKSKYRDPSVMEIKVIAEEDPVKALAILKLQRNNIDLIITDYYMPSMNGLQLKRRITEEIGNLPVIVVSADANKEQESLTCGALGFLPKPIQATDLPKIYQLALTCKRNGKSNYKADDTGASVPQQIKMLPEQANVLKTRKKYSSKAASRSLNSTNGSGLISTDGSRKNRKRKPNGGSEDGAPSQPSKKTKISWTDGLNDLFLQAIRHIGLDKAVPKKILAFMNVPYLTRENVASHLQKYRIFLRKVADQGLMSIMSARGIDSMFRHTQIKESYFNRYTPSTSLYDTSLNNRSIYSKPGQGFGQSRLLSTTREPPVRFNQMPYNYMNRSSTYETHHVGSGSNLTLPIQSNLSLANQPFQNEELRSFFKPPVMANKIGQTSQVHGFGQLGPLAINFNNNMMSSFGSFTPNQPGLGHFSYGMQSFLNNENTAYNPEPHANATTQPNLELPQLEDLNIHSGLGKTNELPYNTSNFQSDHNKQQQGEEASNKFELPSFFSAELNQFLSLEDDSDCTFVNVNEGHSSGEIANTFAAPETNHSYFAAPEMNPPSFNTNPNQNQEQDANRDISDWSFLDPQDLVDDDFMNSLFNNDMN

SEQ ID NO: 20 - protein, 225 aa, Camelina sativa
MSSSGNPSSSGGGGGPCGACKFLRRKCVAGCIFAPYFDSEQGAAHFAAVHKVFGASNVSKLLLHIPEHKRPDAVVSICFEAQARLRDPIYGCVSHIVSLQQQVVSLQTELSYLQAHLATLELPQPMAPVSSSGSLQALSITDLPTISPSLYDLSSFFEPVMSSTWAMQQQPRPSDHVFGVPSSSSIIGGGGELQALAREFIQGGQMPAQPSLGTGGSASTVIKRE

SEQ ID NO: 21 - protein, 515 aa, Camelina sativa
MDGSINIPTEKSAGADKRELQGLLKEAVQSVEWTYSLFWQFCPQQRVLVWGNGYYNGAIKTRKTTQPAEVTAEEAALERSQQLRELYETLLAGESTSEARACTALSPEDLTETEWFYLMCVSFSFSPPSGMPGKAYARRKHVWLSGANEVDSKTFCRAILAKSAKIQTVVCIPMLNGVVELGTTKKVKEDVEFVELIKSFFIGYSNSIPKPALSEHSTYEVHEEVEEEEEEEEEEEEEMTMSGEMRLGSPDDDDVSNQNLRSDLHIESTHTLDTHMDMMNLMEEGGIYSQTVTTLLMSHPTSLLSDSVSTSSYVQSSFSTWRAENVKDHQRVESQWMLKHMILRVPFLHDNTKDKSLPREDLNHVVAERRRREKLNEKFTTLRSMVPFMTKMDKVSILGDTIEYVNHLRKRVHELETTHHDKQHKRTRTCKRKTSEEVEVSIIESDVLLEMRCEYRDGLLLDILQVLHDLGIETTSVHTAVNDGDFEAEIRAKVRGKKASIVEVKRAIHQVIIHN

SEQ ID NO: 22 - protein, 256 aa, Camelina sativa
MMLSSCGGKKPVLSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDVNNIHKPEEEEVSGGQNPLEPNSSSHTDTTGNEASNKNSINVFGGEGYYEDFGFCYDDKFSSFLNSLINDDDDPFGNMIPISQPLQMDDCKEEIVGASSSLGDDQIDKKIYS

SEQ ID NO: 23 - protein, 263 aa, Camelina sativa
MSGGGNTITAVGGGGGGCGGGGSSGGGGSSSGSGGGGPCGACKFLRRKCVPGCIFAPYFDSEQGSGYFAAVHKVFGASNVSKLLLHIPVHRRSDAVVTICYEAQARIRDPIYGCVAHIFALQQQVVNLQAEVSYLQAHLASLELPQPQTRPPPLSQQQQLFFAPAPPFSVTDLPASVSPLPSTYDLASIFDQTTPSSAWATQQRRFVDPRQQYGVPSSSSSAAAIGLGGENSDLQALAHELLHRQGSPPPAATDDSPSRSMSR

SEQ ID NO: 24 - protein, 191 aa, Camelina sativa
MSSSGNPSSSGGGGGPCGACKFLRRKCVAGCIFAPYFDSEQGAAHFAAVHKVFGASNVSKLLLHIPEHKRPDAVVSICFEAQARLRDPIYGCVSHIVSLQQQALSITDLPTISPSLYDLSSFFEPVMSSTWAMQQQPRPSDHVFGVPSSSSIIGGGGELQALAREFIHGGQMPAQPSLGTGGSASTVIKRE

SEQ ID NO: 25 - protein, 244 aa, Camelina sativa
MMTSAHQSNTSSFKPRRIKTMTKSPRQINNKEPSSPATTQPVLKCPRCDSVNTKFCYYNNYSLSQPRHYCKNCRRYWTRGGALRNVPIGGSTRNKNKPCNLHVISSPPLFSNVTTSSSSRELVRNHPSTTTMMMMSSGGFSGYMFPLDPNYNLASSSSIESLSSFDQDLHLKLQQQRLIASMIHQDSLTVNEKPVLFQNGELIPPSTATTVWGFDRSAVVTSGSHEDNGDGEGNLENWFHNAML

SEQ ID NO: 26 - protein, 365 aa, Camelina sativa
MGRHSCCYKQKLRKGLWSPEEDEKLLNHITNHGHGCWSSVPKLAGLQRCGKSCRLRWINYLRPDLKRGAFSPEEENLIVELHAVLGNRWSQIASRLPGRTDNEIKNLWNSSIKKKLKQRGIDPNTHKPISEVESFSDKDKPTTSNNNKRSGNGHKSPSSSSATNQDFFLERPSDFSDFFGFQKLNFNSNLGLSVTTDPSLCSIIPPQFSSGNMVGSVFQTPVCVKPSISLPQDNSSSPVSGGEHVKSAGPNWEFQTNNNTSNFFDNGGFSWSIPNSSSSQVKQNHNFEEIKWSEYLNTPFFIGSTVQSQSSQPIYIKSETDYLANVSNMADPWSQSQNENLGTTEASDVFSKDLQRMAVSFGQSL

SEQ ID NO: 27 - protein, 235 aa, Camelina sativa
MRISCNGCRVLRKGCNKDCTIRPCLQWIKSADSQANATLFLAKFYGRAGLLNLIESGPDHLRPAIFRSLLYEACGRIVNPVDGSVGLMWSGNWAQCQAAVDAVLNGLPITHTPLPSASASHQIIPPHRTYDIRHVAKDPTTGGDSSESLATRVNANKGKTQTGRFKRHAESVNQQGECSHDTWQLPSSGATHGYGHFTLETVESRREAPLDQSSSNLGFDDQVDINEVGLELRLG

SEQ ID NO: 28 - protein, 235 aa, Camelina sativa
MMTSSHQSNTSSFKPRRIKTMTKSPRQIDNKERSSPATTKPVLKCPRCDSVNTKFCYYNNYSLSQPRHYCKNCRRYWTRGGALRNVPVGGSTRNKNKPCSLHVISSPPLFSNVTTSSTTTMMMMSSGGFSGYMFPLDPNYNLASSSSIESLSSFNQDLHQKLQQQRLIASMIHQDSLPVNEKPVMFQNGELIPLSTDWGFDRSAMGGGATSGSHGDNGDGEGNLGNWYHNANAML

SEQ ID NO: 29 - protein, 154 aa, Camelina sativa
MNQGTYSDGSTSKFVKAYLPGESGDDLVLPISFNSCLPKSLPKTVTVRSVSGKIWNMVLRKCGGDYEAERFVMHIPAHVIKDYGLTFPERITVVDKLGGLEKKIKIQGNGCVFVKGFGSVFRRNKMKTTDKMICEVKRTGTNLVHTIKVNIIRG

SEQ ID NO: 30 - protein, 281 aa, Camelina sativa
MGDNTAEDHDDLAMVEAEGVTSFSELLMFSDGVLSSSDHQHESSSGGDGGGEDSLGFVFSGKTGSRMLCFSGDYQNDDASLFLEPSSLPSSGVSVLDPSCIKIDDCKNFKDACTVDKSTKPSNKKRTGTGNEHEPDQNRKPGKKCKRNQDKSSVGVGTVKVRKERLGERIAALQQLVSPYGKTDAASVLHEAMGYIKFLQDQIQVLCSPYLINHTLVDGGVVTGDVMAAMKAKDLRSRGLCLVPVSSTVHVENSNGADFWSPATMGHTTTTSPSTLHHQGF

SEQ ID NO: 31 - protein, 732 aa, Camelina sativa
MSEPNMVPVDNNGDNDNNENNNMNNTDVGLYNTNGGADAGVEADAGVGAGTEAEESDSREEEMGSDQGPSRKRKKYHRHNQYQIQEMEAFFKECPHPDDKQRKDLGRQLGLAPAQIKFWFQNKRTQNKNQQERCENTELRSLNTMLKSENERFREAVYLALCPKCGGKTAIGEMSFEEHHLRIVNARLKEEINELTALAVRFSSKSVVSNPVMSPRPSNRPPTFEFEAGSSSGTGGNLSREITGPADADSRMIMGLAIGAMEELMLMAQVDEPLWMGGFNGTSLALNLDEYARTFRKGLGPRLSGFRTEASRETALVAMNPTGVVEMLMQANLWSTMFVGMVGRAITHENLLTDTAGNFNGALQIMSAEYQVLSPLVSTRESYFVRYCRQQGENLWAVVDVSIDHLFPNIHMKCRRRPSGCLIQETPNGYSKVTWVEHVEVDDREANQNIFKHFISSGQAFAANRWVATLERQCERIASIMTTDFRSVDSPDHLVLTDHGKMSILKLAERVSRNFFVGLTSSMGTTFSGAGGDDIRVMTMKNINDPGRPPGVVISAATSFWVPAPPNIVFDSLRDVDHRDSWDVLCGGGVVVHKISEIANGRDSRNCATLLRNAIPCEKNMMIIQETSTDPTASFVVYAPVDTASIEGVLSEGQDPDYVPLLPSGIAILPDGMGDEHGGSLLTVSFQMLVEEVHMGKLSITSVATAETLIRTTVMKIKALFPFQIATPSLGK

SEQ ID NO: 32 - protein, 516 aa, Camelina sativa
MLVQTIPVAFFVKYIKGRDEQKKTAKLRSDASKIIWNVKLDGQRLTDGWKEFALAHDLRIGDIVIFRQERDLAFHVTLLGPSCCEIQHGSCLEEESNLEKKKEKKSPNEENEQDSCFVVNVAPSSLRYDLLLFPKAFVRENGVVTGSGEIVLMNEKGRSWTLKMKQKPSCGTIYIRGGWINFCHANGLKSGDTVTFKMIQRRGTRVLRLLPKEQKEEANDVSLSTEPESDEDSNIRKIQRQRKMKKSPRRDTESSSLDNSCFVASIAPSSLRYDTMYLPKKFMRENGIYTKRGEMILMNQKGRSWTLDLRRKNWCGTFFIKRGWKSFCRANGLSAGSIVTFKLIKKRGTLTLRLIPNEGEEEEEESSEANKGESLSRDQESDEESSHDEKNSQECSRRNEKKRRLLRWTASSSPSKNRFVTLTLTPYNVSASVLRLPRPFTRMNDIDKKTKMTLLDKQGKKWSTKLHLEDDKSKRLRMVGGWKGFLQANCVKANESIMLELIWEEDTICVLKFRSK

SEQ ID NO: 33 - protein, 231 aa, Camelina sativa
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLAEIENMQKREIELDNENIYLRTKVAEVERFQQHHHQMVSGSEINAIEALAASRNYFAHSIMTAGSGSGNGGSYSDPDKKILHLG

SEQ ID NO: 34 - protein, 364 aa, Camelina sativa
MGRHSCCYKQKLRKGLWSPEEDEKLLNHITNHGHGCWSSVPKLAGLQRCGKSCRLRWINYLRPDLKRGAFSPEEENLIVELHAVLGNRWSQIASRLPGRTDNEIKNLWNSSIKKKLKQRGIDPNTHKPISEVESFSDQDKPTTSNNKRSGNDNKSPSSSSATNQDFFLERPSDFSDFFGFQKLNFNSNLGLSVTTDPSLCSMIPPQFSSGNMVGSVFQTPVCVKPSISLPQDNSSSPVSGGEHVKLAASNWEFQTNNNTSNFFDNGGFSWSIPNSSSSQVKQNHNFEEIKWSEYLNTPFFIGSTVQSQSSQPIYIKSETDYLANVSNMADPWSQSQNENLGTTEASDVFSKDLQRMAVSFGQSL

SEQ ID NO: 35 - protein, 284 aa, Camelina sativa
MLPLGVTAKIQANVSKPCFWKSLSSGQSWKSKSMRIIPDKFVGSTSGAFEHSVVISVRWGNSWQLWLEREKDVLYMIKEDWDEFVDDNHLGPNDNLFFRHDDTMLLEVQIFKNNGDEIMDVPLGVEPETEPLHSNPSNSYKDTTTASASASVEFSANGGTNCRAKEGCAAIENPERYLLNPENPYFVKTLSKKIDVLYVPKTVIQKYGLKFGPHESTMSYLLPNDKINGLTKFYASGKSVCFNGWVGLCRKYNLKAGDSVVCELERSGGLVTAVRVHFFNENMR

SEQ ID NO: 36 - protein, 980 aa, Camelina sativa
MLSIGEGNVMTSDNMRFASQQPSSSSPGTIQNPNFNFIPFNSFSSIIPKEEHGMMSMMMMMGDGTVEEMMENGSAGGSFGSGSEQAEDPKFGNESDVNELQDDEQPPPAKKKRYHRHTNLMLSIGEGNVMTSDNMRFASQQPSSSSPGTIQNPNFNFIPFNSFSSIIPKEEHGMMSMMMMMGDGTVEEMMENGSAGGSFGSGSEQAEDPKFGNESDVNELQDDEQPPPAKKKRYHRHTNRQIQEMEALFKENPHPDDKQRKRLSAELGLKPRQVKFWFQNRRTQMKAQQDRTENAMLRAENANLKSENCHLQGELRCLSCPSCGGPTVLGDIPFNELHIENCRLREELDRICCITSRYTGRPMQSMPSSQPLIDPSSTLPHHQPSLELDMSVYAGNFPEHSCADMMMLPSQDTTCFFPDQTVNNNNNNMLLAEEEKVIAMEIAVSCVQELTKMCDAEEPLWIKKKSDKISGEILCLNEEEYMRLFPWPVENHNNKADFAREASKANSVVIMNSITLVDAFLNADKWSEMFCSIVARAKTVQIISSGVSGASGSLLLMYAEFQVLSPLVPTREAYFLRYVEQNAENGNWAIVDFPIDSFHDQMQPPSTNSPHEYKRKPSGCIIQDMPNGYSQVKWVEHVEVDEKHVHETFAEYVKSGMAFGANRWLDVLQRQCERIASLMARNITDLGGYDIISRSEEKHDEVITEDDTVRITTRKMCEPGQPTGVLLSAVSTTWLPFTHHQVFDLIRDQHHQSLLEVLFNGNSPHEVAHIANGSHPGNCISLLRINVASNSWHNVELMLQESSIDNSGSLIVYSTVDVDSIQLAMNGEDSSNIPILPLGFSIVPVASNSWHNVELMLQESSIDNSGSLIVYSTVDVDSIQLAMNGEDSSNIPILPLGFSIVPVNPPEGISVNSNSPPSCLLTVAIQVLASNVPTAKPNLSTVTTINNHLCATVNQITSALTSSVTPAIASSAAVSKQEAS

SEQ ID NO: 37 - protein, 225 aa, Camelina sativa
MERGGFHGYRKLSLGTTTPPAPEGTMRPSEFIQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCGAGSVSMTNGLVVKRPNGAMSEYGAYGPVPGIHMAQYHYRHQNGFVFSGNEPNSKMSGSSSAASGARVEVFPTQQNKY

SEQ ID NO: 38 - protein, 278 aa, Camelina sativa
MGDNSAEDHDDLALVEAEGVTSFSELLMFSDGVLSSSDHQRESSSGGDGGEDSLGFVFSGKTGSRMLCFSGGYQNDDASLFLEPSSLPSSGVPVLDPSCIKIDDCKNFKDACTVDKSTKPSNKKRTGTGNEHEPDQNRQPGKKCKRNQDKSSLGTVKVRKERLGERIAALQQLVSPYGKTDAASVLHEAMGYIKFLQDQIQVLCSPYLINHTLADGGVVTGDVMAAMKAKDLRSRGLCLVPVSSTVHVENSNGADFWSPATMGHTTTTSPSTLHHQGF

SEQ ID NO: 39 - protein, 598 aa, Camelina sativa
  misc_feature (595)..(595): Xaa can be any naturally occurring amino acid
MLSIGEGNVMTSDNMRFASQQPSSSSSPGTIQNPNFNFIPFNSFSSIIPVLMLSIGEGNVMTSDNMRFASQQPSSSSPGTIQNPNFNFIPFNSFSSIIPKEEHGMMSMMMMMGDGTVEEMMENGSAGGSFGSGSEQAEDPKFGNDSDVNELQDDEQPPPAKKKRYHRHTNRQIQEMEAYAQQDRTENAMLRAENANLKSENCHLQGELRCLSCPSCGGPTVLGDIPFNELHIENCRLREELDRICCITSRYTGRPMQSMPSSQPLIDPSSTLPHQPSLELDMSVYAGNFPEHSCADMMMLPPQDTTCFFPDQTVNNNNNNMLLAEEEKVIAMEIAVSCVQELTKMCETEEPLWIKKKSDKISGEILCLNEEEYMRLFPWPVENHNNKADFAREASKANSVVIMNSITLVDAFLNADKWSEMFCSIVARAKTVQIISSGVSGASGSLLLMYAEFQVLSPLVPTREAYFLRYVEQNAENGNWAIVDFPIDSFHDQMQPPSTNSPHEYKRKPSGCLIQDMPNGYSQVKWVEHVEVDEKHVHETFAEYVKSGMAFGANRWLDVLQRQCERIASLMARNITDLGGYDIISRSEEKHDEVXLVI

SEQ ID NO: 40 - protein, 231 aa, Camelina sativa; identical to SEQ ID NO: 33

SEQ ID NO: 41 - protein, 232 aa, Camelina sativa
MERGGFHGYRKLSLGTTTTPPAPANFLVAEGTMRPSEFIQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCGAGSVSMTNGLVVKRPNGNMSEYGAYGPVPGIHMAQYHYRHQSGFVFSGNEPNSKMSGSSSAASGPRVEVFPTQQHKY

SEQ ID NO: 42 - protein, 239 aa, Camelina sativa
MERGAPFSPYQLPKPNSGLNMDQLSNPNSMTSSVVTAGGTSDKNKGVAVQQQPCMAREQDQYMPIANVIRIMRKSLPAHAKISDDAKETIQECVSEYISFVTGEANERCQREQRKTITAEDILWAMSKLGFDNYVDPLTLYINRYREIETDRGSALRGEPAVSFRQTYGGSGIGFHGPPHSLPPSGPYGYGMVDPTMGMGGGRYYQNGSGQDGSGSGTGGSSSSINGMSSVYDPYGQYK

SEQ ID NO: 43 - protein, 312 aa, Camelina sativa
MALETGFPPFPDFLKIFNSHEHSQRLVIPRGYKQYYPNPLPQTAVLKRAEGKFWTVRWTISQEETISFQEGWEKFVRGNGLIDRDFLLFTYDGSRSFWVRIHRDGLPLEPSCPIKIQEISDDEDETVGDDDGRDHHMEEGDTYENMVVSLSLGSSDEINGDDEDEDDDDDYDDDEDTATCVVNKASGSSYKKARRVKKTRATSIADSVKVQTYLENPKNPFFISTSSCSRRVLVISMQAIKDFKLKFENTINLVDDFGLLKRKVGKWKDRVVVHKWDEMYNRNKIKPGDIIICEILREGDVVRTVKVHFVKN

SEQ ID NO: 44 - protein, 235 aa, Camelina sativa
MRISCNGCRVLRKGCNQDCTIRPCLQWIKSADSQANATLFLAKFYGRAGLLNLIESGPDHLRPAIFRSLLYEACGRIVNPVDGSVGLMWSGNWAQCQAAVDAVLNGLPITHTPLPSASASHQIIPPHRTYDIRHVAKDPTTGGDSSESLSTRVNANKGKTQTGRFKRHAESVNQQGECSHDTWQLPSSGATHGYGHFTLETVESRREAPLDQSSSNLGFDDQVDINEVGLELRLG

SEQ ID NO: 45 - protein, 259 aa, Camelina sativa
MMLSSCGGKKPVLSKKTTPCCTKMGMKRGPWTVEEDEILVSFIKKEGEGRWRSLPKKAGLLRCGKSCRLRWMNYLRPSVKRGGITSDEEDLILRLHRLLGNRWSLIAGRIPGRTDNEIKNYWNTHLRKKLLRQGIDPQTHKPLDVNNIHKPEEEEVSAGLNPLEPNSSSHTNTTVNSGIGTSNKNSINVFGGEGNYEDFGFCYDDKFSSFLNSLINDDDDPFGNMIPISQPLQMDDCTEEIVGASSSLGNDQIDKKIYS

SEQ ID NO: 46 - protein, 239 aa, Camelina sativa
MERGAPFSPYQLPRPNSGLNSDQLSNPNSMTSSVVTAGGTSDKNKGVAVQQQPCMAREQDQYMPIANVIRIMRKSLPAHAKISDDAKETIQECVSEYISFVTGEANERCQREQRKTITAEDILWAMSKLGFDNYVDPLTLYINRYREIETDRGSALRGEPAVSFRQTYGGNGIGFHGPPHSLPPSGPYGFGMVDPTMGMGGGRYYQNGSGQDGSGSGTGGSSSSINGMSSVYDPYVQYK

SEQ ID NO: 47 - protein, 232 aa, Camelina sativa
MARGKIQIKRIENQTNRQVTYSKRRNGLFKKAHELTVLCDARVSIIMFSSSNKLHEYISPNTTTKEIVDLYQSISEVDVWSTQYERMQETKRKLLETNRNLRTQIKQRLGECLEELDYHELRRLEDEMENTFKLVRERKIKSLGNQIETTKKKNKSQQDIQKNLIHELELRAEDPHYGLVDNGGDYDSVLGYQIEGSRAYALRYHQNHHHHYPNHALHAPSASDIITFHLLE

SEQ ID NO: 48 - protein, 231 aa, Camelina sativa
MERGGFHGYRKLSLGTTTPPAPANFLVAEGTMRPPEFIQPNKTSNGSEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCGAGSVSMTNGLVVKRPNGNMSEYGAYGPVPGIHMAQYHYRHQNGFVFSGNEPNSKMSGSSSAASGARVEVFPTQHNKY

SEQ ID NO: 49 - protein, 277 aa, Camelina sativa
MADQQRPHNTSDSRRKSLAGRRTSSQQTPTTSSLSSGGGSIAAATTTGTGTASPCGACKFLRRKCVSGCIFAPHFGSDQGAARFAAVHKVFGASNVSKLLHHIPVNRRHDAVVTISYEAQARLSDPVYGCVSTILALQQQVASLQAELSVVQSQLINSRVAMANVMQQQTHHQQQQQQQLVVMQQPEYSNNSSASTTLAGAAMNSFTVAAEAADVSYDVMAPTNLEHSLPPMPPHQQSRGDQHHEDEEESGADFSVAVGSTAVASEVIFPAEGFHRR

SEQ ID NO: 50 - protein, 190 aa, Camelina sativa
KVFGASNVSKLLLHIPVHRRSDAVVTICYEAQARIRDPIYGCVAHIFALQQQVVNLQAEVSYLQAHLASLELPQPQTRPQPLSQQQPLFFAPPPPFSVTEPASVSPLPSTYDLASIFDQNTPSSAWATQQRRFVDPRQQYGVPSSSSSAAAIGLGGENSDLHALAHELLHRQGSPPPAATDDSPSRSMSR

SEQ ID NO: 51 - protein, 250 aa, Camelina sativa
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYESLQRQQRNLLGEDLGPLNSKELEQLERQLDGSLKQVRCIKTQYMLDQLSDLQGKEHILLEANRALSMKLEDMIGVRHHHIGGAWEAGDQHNVAYGHHQAHSQGLYQSLECDPTLQIGYGHPVCSEQMAVTTQGQSQPGNGYIPGWML

SEQ ID NO: 52 - protein, 277 aa, Camelina sativa
MHNQINNSHPQKIHHNSWTHLFQSSGIKRTTTERNSDAGSFLRGFDVNRAASSVVAVVNLEEEAAVVSSPNSTISSVSGNKRDLAAARGGGEEHEAERASCSHGGGSDDEDCGNGDGSRKKLRLSKEQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSSSSANVTAVLPPPATVVGRPSPQRSTPWTAISLQQVQRSGR

SEQ ID NO: 53 - protein, 278 aa, Camelina sativa
MGDNTAEDHGDLALVEAEGVTSFSELLMFSDGVLSSSDHQRESSSGGDGGEDSLGFVFSGKTGSRMLCFSGGYQNDDASLFLEPSSLPSSGVSVLDPSCIKKDDCKNFKDACTVDKSTKPSNTKRTGTGNEHEPDQNRKPGKKCKRNLDKSSLGTVKVRKERLGERIAALQQLVSPYGKTDAASVLHEAMGYIKFLQDQIQVLCSPYLINHTLADGGVVTGDVMAAMKAKDLRSRGLCLVPVSSTVHVENSNGADFWSPATMGHITTTSPSTLHHQGF

SEQ ID NO: 54 - protein, 232 aa, Camelina sativa
MARGKIQIKRIENQTNRQVTYSKRRNGLFKKAHELTVLCDARVSIIMFSSSNKLHEYISPNTTTKEIVDLYQSISDVDVWSTQYERMQETKRKLLETNRNLRTQIKQRLGECLEELDYHELRRLEDEMENTFKLVRERKIKSLGNQIETTKKKNKSQQDIQKNLIHELELRAEDPHYGLVDNEGDYDSVLGYQIEGSRAYALRYHQNHHHHYPNHALHAPSASDIITFHLLE

SEQ ID NO: 55 - protein, 161 aa, Camelina sativa
MVTTRRTKARVTSSSHRRPPQDPESPVKTFFKLVLPSTMKKDMMRIPPTFVKLQGSNLPDVVTLKTPVGFKRSIKLKRIGQEIWFHEGWSEFAEAHSIKEGHFLLFQYYEISSFRTKGLLELKLQGGIINLLMVVIQNTTPRRDQVTLSLTRFYTVRRLCS

SEQ ID NO: 56 - protein, 277 aa, Camelina sativa
MADQQRPHNTSDSRRKSLAGRRTSSQQTPTTSSLSSGGGSINAAATTTTGTGTASPCGACKFLRRKCVSGCIFAPHFGSDQGAARFAAVHKVFGASNVSKFLHHIPVNRRHDAVVTISYEAQARLSDPVYGCVSTILALQQQVASLQAELSVVQSQLINSRVAMANVMQQQTHHQQQQQLVVMQQPEYSNNSSASTTLAGAAMNSFTVAAEAAAVSYDVMAPTNLEHSLPPMPLNQQSRGDQHHEDEEESGADFLVAVGSTAVASEVIFPAEGFHRR

SEQ ID NO: 57 - protein, 273 aa, Camelina sativa
MADQQRPHNTSDSRRKSLAGRRTSQQTPTTSSLSSGGGSIAAATTTGTGTASPCGACKFLRRKCVSGCIFAPHFGSDQGAARFAAVHKVFGASNVSKLLHHIPVNRRHDAVVTISYEAQARLSDPVYGCVSTILALQQQVASLQAELSVVQSQLINSRVAMANVMQQHTHHQQQQLVVMQQPEYSNNSSASTTLAGAAMNSFTVAAEAAAVSYDVMAPTNLEHSLPPMPPHQQSRGDQHHEDEEESGADFSVAVGSTAVASDVIFPAEGFHRR

SEQ ID NO: 58 - protein, 241 aa, Camelina sativa
MERGAPFSPYQLPRPNSGLNSDQLSNPNSMTSSVVTAGGTSDKNKGVAVQQQPCMAREQDQYMPIANVIRIMRKSLPAHAKISDDAKETIQECVSEYISFVTGEANERCQREQRKTITAEDILWAMSKLGFDNYVDPLTLYINRYREIETDRGSALRGEPAVSFRQTYGGNGIGFHGPPHSLPPSGPYGYGMVDPTMGMGGGRYYQNGSGQDGSGSGTGTGGSSSSINGMSSVYDPYVQYK

SEQ ID NO: 59 - protein, 753 aa, Camelina sativa
MMSMMMMMGDGTVEEMMENGSAGGSFGSGSEQAEDPKFGNESDVNELQDDEQPPPAKKKRYHRHTNRQIQEMEALFKENPHPDDKQRKRLSAELGLKPRQVKFWFQNRRTQMKAQQDRTENAMLRAENANLKSENCHLQGELRCLSCPSCGGPTVLGDIPFNELHIENCRLREELDRICCITSRYTGRPMQSMPSSQPLIDPSSTLPHHQPSLELDMSVYAGNFPEHSCADMMMLPPQDTTCFFPDQTVNNNMLLAEEEKVIAMEIAVSCVQELTKMCDTEEPLWIKKKSDKIGGEILCLNEEEYMKLFPWPVENHNNKADFAREASKANSVVIMNSITLVDAFLNADKWSEMFCSIVARAKTVQIISSGVSGASGSLLLMYAEFQVLSPLVPTREAYFLRYVEQNAENGNWAIVDFPIDSFHDQMQPPSTNSPHEYKRKPSGCIIQDMPNGYSQVKWVEHVEVDEKHVHETFAEYVKSGMAFGANRWLDVLQRQCERIASLMARNITDLGGYDIISRSEEKHDEVITEDALSETSKDTVRITTRKMCEPGQPTGVVLSAVSTTWLPFTHHQVFDLIRDQHHQSLLEVLFNGNSPHEVAHIANGSHPGNCISLLRINVASNSWHNVELMLQESSIDNSGSLIVYSTVDVDSIQLAMNGEDSSNIPILPLGFSIVPVIPPEGISVNSNSPPSCLLTVAIQVLASNVPTAKPNLSTVTTINNHLCATVNQITSALTSTVTPAIASSAAVSKQEAS

SEQ ID NO: 60 - protein, 303 aa, Camelina sativa
MGRGRVELKRIENKINRQVTFAKRRNGLLKKAYELSVLCDAEVALIIFSNQMGRGRVELKRIENKINRQVTFAKRRNGLLKKAYELSVLCDAEVALIIFSNRGKLYEFCSSPNMLKTLDRYQKCSYGSIEVNNKPAKELENSYREYLKLKGRYESLQRQQRNLLGEDLGPLNSKELEQLERQLDGSLKQVRSIKTQYMLDQLSDLQNKEQMLLETNRALAMKLDDMIGVRSHHMGGGGGGWDGGEQNVTYAHHQAHSQGLYQPLECNPTLQIGYDNPVCSEQITATTQAQAQQGNGYIPGWML

SEQ ID NO: 61 - protein, 403 aa, Camelina sativa
MASQLPGRTDNEIKNYWNTRMKRRQRAGLPLYPHDTHQHHQGIDDNDDDEFEFDLSSFQFQNQDLLHHNQQNMIQYTNSSNTSSSISSSSFYSSSSQPSKKMRPNDPLVSTNPGLNPIPDSPMKFQMFSLYNNSLDENDNSHFGFSLPLSSSSSSNEFCNPNHILEFLSENSDTSNYHKKDIDALSYSSLLMGDHEVRPSSFPLGLENTVLELPSNQTTIDSFSSNPILDNGVHLEPPAGNSGLLDALLEESQALSRGRLFKDVRVSSSDLCNFQEERMKMDFENRLTDHLNSSHQSSLGTNPNIQKYNEPTMVKATVDDDDDLLMSLLNNFPSTTTPLPDWYRMTEIQNEASYLAPTSGSILMGNYQGNSREEEPATVTPSSSVDPTASLGTCYWSNMPRIC

SEQ ID NO: 62 - protein, 147 aa, Camelina sativa
  misc_feature (146)..(146): Xaa can be any naturally occurring amino acid
MEAFGGFHKEDDEQMDLPPGFRFHPTDEELITHYLHNKVLDMAFSAKAIGEVDLNKAEPWELPYKAKMGEKEWYFFCVRDRKYPTGLRTNRATQAGYWKATGKDKEIYRGKSLVGMKKTLVFYRGRAPKGLKTNWVMHEYRLDGKXF

SEQ ID NO: 63 - protein, 382 aa, Camelina sativa
MTTESNDLNRSESESDISAATQVTPTLAIDFSLGCKRVSGPTRRSTKGGWTSEEDELLTNAVQMYKGRHTSWKNIVELVPGLKDKRSEVQCQHRWLKVLDPNLYKGHWTKDEDDLLSKLVKDHMKNDRPQWSKISKQLSGRIGKQCRERWHNHLNPTIIKTAWTREEELILVQSQREHSNKTENNIKNHWNCSVKKRLEQFPSNLSSGSRPSCFEYNFFNQKTLQIEEAAVKSPLKDSLELTLGPTNWRSTPSSTSSLRGDESISSSVESDWSSLNVSESTQETPQSSNDNECIQEVKEIKKRLRMAASTFNTPSIISKRSSPALKRHRQNELNTPFQIDGGSHMSSEEEHSTSPFSKYRLAKRNTCSGSKPLERRLDFDFM

SEQ ID NO: 64 - protein, 258 aa, Camelina sativa
MMLSSCGGKKPVLSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDVNNIHKPEEEVSGGQNPLEPNSSSHTDTTVNSGNEASNKNSINVFGGEGNYEDFGFCYDDKFSSFLNSLINDDDDPFGNMIPISQSLQMDDCMEEIVGASSSLGHDQIDKKIYS

SEQ ID NO: 65 - protein, 231 aa, Camelina sativa
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLAEIENMQKREIELDNENIYLRTKVAEVERFQQHHHQMVSSSEINAIEALAASRNYFAHSIMTAGSGSGNGGSYSDPDKKILHLG

SEQ ID NO: 66 - protein, 225 aa, Camelina sativa
MSSSGNPSSSGGGGGPCGACKFLRRKCVAGCIFAPYFDFEQGAAHFAAVHKVFGASNVSKLLLHIPEHKRPDAVVSICFEAQARLRDPIYGCVSHIVSLQQQVVSLQTELSYLQAHLATLELPQPMAPVSSSGSLQALSITDLPTISPSLYDLSSFFEPVMSSTWAMQQQPRPSDHVFGVPSSSSIIGGGGEIQALAPEFIHGGQMPAQPSLGTSGSASTVIKRE

SEQ ID NO: 67 - protein, 404 aa, Camelina sativa
MEENCEDCMQWEEELYWTHFQTLHFSQLLLPGFHHCLVIPQKFSIHCKRKLPQIVTLKSPSGAIYNVKVEQDDVEKTLAFRCGWDKFVKDHSLKGNDLLVFKFHGVSEFEVLIFDGQTLCERPASYFVRKCGHADKTKGTDFTATSSRSPEIHFNPVDLETTPNQQRLITPPVVDNELEDLIDIDVEIDTMLTPRLVVSQTGYDQEEHFNSDIDTASAQLPVISPTSTGRVSKEKYPLSGLKKMRGEISNDSLDHKLGTDFTATSSRSPEIHFNPGDVETSPNQQRLISPPVVDINELEDLIDIDVEIDTMLTPRLVVSQTGYDQEEHFNSDIDTASAQLPVISPTSTGRVSKEKYPFSGLKKMRGEISNDSLDHKPGMKIFLLIDYTLHQFLGIHLICPVPGP

SEQ ID NO: 68 - protein, 340 aa, Camelina sativa
MGRAPCCEKVGMKKGRWTAEEDQILTDYIQSNGEGSWRSLPKNAGLKRCGKSCRLRWINYLRSDLKRGNITPQEDDLIVKLHSTFGSRWSIIASNLPGRTDNEIKNYWNSHLSRKLHGNFRKPTVTDVVENAPLPPKRKPGRTSRSAMKPKFIPTSKNPKSLIKANKNEIVLPTTIIEINGDKEDALMDLSSSSVVSGAKEPGLGPCGYGDDGHCNPSINGDLCINDDIFDACFLLNEPDAVHVSSFESNNVENSEPYGSSSASAGHENIESMADDFIDWDLVWREGETLWDEKEDLDSVLSWLFQGDEKESESRQKDSNDFGEPLDFEQENKMAAWLLS

SEQ ID NO: 69 - protein, 195 aa, Camelina sativa
MDDNNQRPCIPKEEPAMDTGDWRTQLPPDSRQKIVNKIFETLKTYLPFQSSLSGLEEIRSIATRFEERVFSGALNQTDYLQNISMKMRTLQTKSQNAAGSSSSSIPAAANSVTSMDSGEPAANTDDWRTQVPPDSRQSNAYKIMETLEKRVPNLGLQGINELMRIAVSFEDLIFKNAINQVDYFRKVSFTVDEGD

SEQ ID NO: 70 - protein, 249 aa, Camelina sativa
MMTSSHQSNTSSFKPRRIKTMTKPPRQINNKEPSSPATTQPVLKCPRCDSVNTKFCYYNNYSLSQPRHYCKNCRRYWTRGGALRNVPVGGSTRNKNKPCSLHVISSPPLFSNVTTSSSSRELVRNHPSTTTMMMMSSGGFSGYMFPLDPNFNLASSSSIESLSSFNQDLHLKLQQQRLIASMIHQDSLPVNEKPVMFQNGELIPPSKDWGFDRSAMGGGGATSGSHGDNGDGEGNLGNWYHNANNNAML

SEQ ID NO: 71 - protein, 527 aa, Camelina sativa
MANKHFFKPLLPGFQRHLTIPVAFFVKYIKGRDEQKKTAKLRSDASKIIWNVKLDGQRLTDGWKEFALAHDLRIGDIVIFRQERDLAFHVTLLGPSCCEIQYGSCLEEESNLEKKEKKSPNEENEEDSCFVANVAPSSLRYDSLLFPKAFVRENGVVTGSGEIVLMNEKGRSWTLKMKQKPSCGTIYIRGGWINFCHANGLKSGDTVTFKMIQRRGTRVLRLLPKEQKEEANDVSLSTEPESDEDSNIRKIQRQRKMKKSPRRDTESSSLDNSCFVASIAPSSLRYDTMYLPIKFMRENGIYTKRGEMILMNQKGRSWTLDLRRKNWCGTFFIKRGWKIFCRANGLSAGSIVTFKLIKKRGTLLTLRLIPNEGEDEESSEANKVESLSRDQESDEESSHDEKISQECLRRNEKKRRLRWTASSAPSKNRFVTLTLTPYNVSASVLRLPRPFTRMNDIDKETKMTLLDKQGKKWSTKLHLEDDKSKRLRMVGGWKGFLQANCVKANESIMLELIWEEDTICVLKFRSK

SEQ ID NO: 72 - protein, 250 aa, Camelina sativa
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYESLQRQQRNLLGEDLGPLNSKELEQLERQLDGSLKQVRCIKTQYMLDQLSDLLGKEHILLEANRALSMKLEDMIGVRHHNIGGAWEAGDQHNVAYGHHQAHSQGLYQSLECDPTLQIGYGHPVCSEQMAVTTQGQSQPGNGYIPGWML

SEQ ID NO: 73 - protein, 246 aa, Camelina sativa
MDNVNVLAKGENQLNGEKPPPQVCARCSSFNTKFCYFNNYSMSQPRYFCKECRRYWTQGGTLRNVPVGGGCRKPKRPRIEQSSVSQVAFFEHQPINHQPFRLVHENNESVGLFGGSSSPAAVAAVLGKHLGYLAELRGVTNVPQVRGHRPIVLDRLDFGEDSFQQDYYDVGNDLIGNPFINQSIGGGYVNNHNTCFINQVDLHKWNQSINNTMNVNHEASSSGSRGSSDTETNSNNGNKDQKHLFD

SEQ ID NO: 74 - protein, 295 aa, Camelina sativa
LFIVTQVDPLLLQLYLSLSISFLFFLKKFYFISFFLLYLFVLSPPNLFSKRFKTKVEKKKKKNMARGKIQIKRIENQTNRQVTYSKRRNGLFKKAHELTVLCDARVSIIMFSSSNKLHEYISPNTTTKEIVDLYQSISDVDVWSTQYERMQETKRKLLETNRNLRTQIKQRLGECLEELDYHELRRLEDEMENTFKLVRERKIKSLGNQIETTKKKNKSQQDIQKNLIHELELRAEDPHYGLVDNGGDYDSVLGYQIEGSRAYALRYHQNHHHHYPNHALHAPSASDIITFHLLE

SEQ ID NO: 75 - protein, 199 aa, Camelina sativa
MRNTPTTRRSSVRITSAASQRRLTPEPEPAVKKFIKIINLSTIKEKMMKIPERFVRLGPKLTDNVTLETPVGFKRSIGIKRIGNEVWFEKGWSEFAEAHSLSEGHFLFFHYKGKSSFSVVIFDVTASEIEYPLDKVYVIESDDDDKEEVMEVMDDDDEQGFAGFESSESEGVIELDELLKNKKRIQRVSVKSEKFASFW

SEQ ID NO: 76 - protein, 708 aa, Camelina sativa
MDSSRDDSSSDERGTSTDTNNNQDRRHYHRHTNQQIQRLEAYFKECPHPDDLQRRQLGEELNLKPKQIKFWFQNKRTQAKSHNERAGNAVLRAENMRMRRENEAMEDALKNVVCAPCGGRGFGREEKQRNIQKLRSENAFLKREFERVSNFLAQQGGHSMPSVGAFTYPHGPSTYGSTSNNRRASYRTSSNHLPQPSCSLRGPYARGNISINQPHQLQNEIPVHHFPPLSQMEKLVMFETAAKAVAEVMILIQMEESLWKKSSIDDRLVIDPTNYEKCFAKISHFKGPSGRSESSKEVVVVQTDARILVDMFLDTEKWARLFPTIVNEAKTIHVLDSMDNGRQTLATVIYEQMHILSPLVPPREFIILRSCQQMEENVWMIADVSCNLPNVAFESMAPICTKHPSGVLIEALPNGCSKVTWIEHVEVTDKMRPHRLYRDLFLYGGLGYGARRWTVTLERMCERLYLSSISDFPNNDYAGVVQTIEGRRSVMKLGERMLKDFAWMINMEEKLDFSQQSETNNSGVSIAVRLNNEAGQPPGLILCAGSSLCLPLPPPQWDVLCNGNPVTEPARFVTGTDTKNNVNFIQASSGGDNNSKLMILQDGFIDALGGMVVYAPMDLDTAAAAISGQVDPSAIPILPSGFIISRDGRPNSAEDPDGGSSTLLTVAFQILVCDPNYSAAFKVEESAATVNNVISSTVQRIKAMLNCD

SEQ ID NO: 77 - protein, 1304 aa, Camelina sativa
  misc_feature (672)..(672): Xaa can be any naturally occurring amino acid
MSMAVEMSSKQPTKDFFSSPALSLSLAGIFRNASSGNTDPAEEDFLSRRVVEDEDRTVEMSSENSGPTRSRSEEDLEGEDHDEDLEDDDGNKGNKRKRKKYHRHTTDQIRHMEALFKETPHPDEKQRQQLSKQLGLAPRQVKFWFQNRRTQIKAIQERHENSLLKAELEKLREENKAMRESFSKAANSSCPNCGGGPDDLHLENSKLKAELDKLRAALGRTPYPLQASCSEDQEQRLGSLDFYTGVFALEKSRIAEIANRATLELQKMATSGEPLWLRSVETGREILNYDEYLKEFPQAQASSFPGRKTIEASRDVGIVFMDAHKLAQSFMDVGQWKEMFACLVSKAATVDVIRQGEGPSRIDGAIQLMFGEMQLLTPVVPTREVYFVRSCRQLTPEKWAIVDVSVSVEDSNTEKEASLLKCRKLPSGCIIEDTSNGHSKVTWVEHLDVSASTVQPLFRSLVNTGLAFGARHWVATLQLHCERLVFFMATRVTTLAGRKSVLKMAQRMTQSFYRAIAASSYHQWTKITTKTGQDMRVSSRKNLHDPGEPTGVIVCASSSLWLPVSPTLLFDFFRDEARRHEWDALSNGAHVQSIASLSKGQDRGNSVAIQTVKTREKSIWVLQDSCTNSYESVVVYAPVDINTTQLVLAGHDSSSIQILPCGFSIIPDGVEXFMLFKETPHPDEKQRQQLSKQLGLAPRQVKFWFQNRRTQIKAIQERHENSLLKAELEKLREENKAMRESFSKAANSSCPNCGGGPDDLHLENSKLKAELDKLRAALGRTPYPLQASCSEDQEQRLGSLDFYTGVFALEKSRIAEIANRATLELQKMATSGEPLWLRSVETGREILNYDEYLKEFPQAQASSFPGRKTIEASRDVGIVFMDAHKLAQSFMDVGQWKEMFACLVSKAATVDVIRQGEGPSRIDGAIQLMFGEMQLLTPVVPTREVYFVRSCRQLTPEKWAIVDVSVSVEDSNTEKEASLLKCRKLPSGCIIEDTSNGHSKVTWVEHLDVSASTVQPLFRSLVNTGLAFGARHWVATLQLHCERLVFFMATNVPTKDSLGVTTLAGRKSVLKMAQRMTQSFYRAIAASSYHQWTKITTKTGQDMRVSSRKNLHDPGEPTGVIVCASSSLWLPVSPTLLFDFFRDEARRHEWDALSNGAHVQSIASLSKGQDRGNSVAIQTVKTREKSIWVLQDSCTNSYESVVVYAPVDINTTQLVLAGHDSSSIQILPCGFSIIPDGVESRPLVITTTQDDRNSQGGSLLTLALQTLINPSPAAKLNMESVDSVTNLVSVTLHNIKRSLQIEDC

SEQ ID NO: 78 - protein, 708 aa, Camelina sativa
MDSSHDDSSSDERGTSTDTNNNQDRRNYHRHTNQQIQRLEAYFKECPHPDDLQRRQLGEELNLKPKQIKFWFQNKRTQAKSHSERVDNAVLRAENMRMRRENEAMEDALKNVVCGPCSGRGFGREEKQRNIQKLRAENAFLKREFERYSNFLAQQGGHSMPSVDAFTYPRGPSTYGSTSNNRRASYGTSSNHLPQPSCSLRGPYARGNISLNQPHQLSQMEKLVMFETAAKAVAEVMNLIQMEELWKKSSIDNRLVIDPTNYEKCFGKISHFKGPSGRPESSKEVVVVQMDARNLVDMFLDTEKWARLFPTIVNEAKTMHVLDSMDNGRQTLARVIYEQMHILSPLVPPREFIILRSCQQMEENVWMIADVSCNLPNVEFNSMAPICTKHPSGVLIEALPNRCSKVTWIEHVEVSDKMRPHRLYRDLFLYGGLGYGARRWTVTLERMCERLHLSSISDLPNNDYAGVVQTIEGRRSVLKLGERMLKDFAWMIKMEDKLDFAQQSETNNSGVTIAMRLNHEAGQPPGLILCAGSSLCLPLPPPQVYDFLRNLDIRHQWDVLCNGNSVTEAARFVTGTDTNNNVNFIQASSGGDNNSKLMILQDGFIDALGGMVVYAPMDLKTAAAAISGQVDPSAIPILPSGFIISRDGRPSSAEDPDGGSSTLLTVAFQILVCDPDNCTNFNLEESATTVNTVISSTVQRIKRMLNCD

SEQ ID NO: 79 - protein, 204 aa, Camelina sativa
MGIDPVTHRPRTDHLNVLAALPQLLAAANFNNLLNLNPSVQLDATSVAKAQLLHSMIQVLSNNNTSSSLETHHTNNNLFGQSSFLENLPSIGENLYDPTQSLSHIVNQPLDSFTSPMRVVAHQDDQNSVPPLVSASPDESKQTQMMVKDKEILRHTDHTSNPSSTSTFTQDHQPWCDIIDDEASDSYWKEIIEQTCSEPWPFRE

SEQ ID NO: 80 - protein, 340 aa, Camelina sativa
MRSKLKLSLIANNYLRKQTFKRRKAGIEKKLHEFTTLCGVKACAVICSPYENPVLWPSAEGVQEVVSKVMELPVEDQCKYMFNHETYLRREITKAEKQVEKLRSDNRETQLRQFMFDCLEGKMNQHPYDATDLQDLRSYIGSYIKKLDFRMKVLTEENGESSSSTLLLPSSVAGADSPAVEVTGHPVVADASMVTELNGFYGYFPYDGMTMNPIPNQHESLVQHHVPVDSVQHHVPVGSVEYHTPMNFDDQIQHGIYDMNLHQDMSLDPNQYPYQQGSFMNLLLGHPQEMGYDGEHAHIPFVNGNYHQLPTMDFATTGHMPSINTNTIAGVYAPDDINAL

SEQ ID NO: 81 - protein, 308 aa, Camelina sativa
MNISTTNPDQELTEIGASGSGTNNYFFNSEMREHMFDKVLTPSDVGKLNRLVIPKQHAENYFPLEDNQNGIVLDFQDRLGKLWRFRYSYWNSSQSYVMTKGWSRFVKEKKLTSGDTVSFHRGYIPDENAPERRLRIVLIDWSHKADRNQHSLGSYPTVTFYPAPEYSMPSHRSFPPFHHNQYQERESPRYGYGRIVYGGSYYEGSPLVYASVPVFPPAMRVPPPAPPQPSTTRKLRLFGVDVEESSSSGETRGEMGVAGHSSSSPVVIRDDDESSLRSPRGEMGAGTSSAMQLCDDEDYKRKGKSLEL

SEQ ID NO: 82 - protein, 173 aa, Camelina sativa
MENNNQLPPSYSQPQPQTESSNIRDYWIEQMENVTDFKNRQLPLARIKKIMKADPDVHMVSADAPVLFAKACEMFIMDLTSRSWRHAEENKHHTLQKSDISAAVASTYTYDFLLDVVPKDVDPGFAPMPHPDGVPQYYYPPGIYPSPPTQAWPEEAGEEEDEAEGSGRNGGGN

SEQ ID NO: 83 - protein, 338 aa, Camelina sativa
METFCGFQKEEEQMDLPPGFRFHPTDEELITHYLHKKVLDISFSAKAIGEVDLNKSEPWELPWMAKIGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPTLLPSLTDSSPYNDKTKTEPVYVPCFSNQTDQNQGTTTLNCFSSPALNSIQTDIFHRIPLYQTQSLQVSTNLLHSPILAQEHSVLHAMIENNRRQSHKTMSVSQETGVSTDMNTDISSDFEFGKRLFDTQEDPSSSTGPVDLEPFWNY

SEQ ID NO: 84 - protein, 176 aa, Camelina sativa
MENNNQPPPSYSQPQPPQTESSNPHIRDYWIEQMENVTDFKNRQLPLARIKKIMKADPDVHMVSADAPVLFAKACEMFIMDLTNRSWRHAEENKRHTLQKSDISAAVAGTYTYDFLLDVVPKDADPGFAPMPHPDGVPQYYYPPGIYPSPPTQAWPEEAGEGEDEAEGSGRNGGGN

SEQ ID NO: 85 - protein, 250 aa, Camelina sativa
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYESLQRQQRNLLGEDLGPLNSKELEQLERQLDGSLKQVRCIKTQYMLDQLSDLQGKEHILLEANRALSIKLEDMIGVRHHHIGGAWEAGDQQNVAYGHHQAHSQGLYQSLECDPTLQIGYGHPVCSEQMAVTTQGQSQPGNGYIPGWML

SEQ ID NO: 86 - protein, 251 aa, Camelina sativa
MGRGRVELKRIENKINRQVTFAKRRNGLLKKAYELSVLCDAEVALIIFSNRGKLYEFCSSPNMLKTLDRYQKCSYGSIEVNNKPAKELENSYREYLKLKGRYESLQRQQRNLLGEDLGPLNSKELEQLERQLDGSLKQVRSIKTQYMLDQLSDLQNKEQMLLETNRALAMKLDDMIGVRSHHMGGGGGWDGGEQNVTYAHHQAHSQGLYQPLECNPTLQIGYDNPVCSEQITATTQAQAQQGNGYIPGWML

SEQ ID NO: 87 - protein, 351 aa, Camelina sativa
MSSSSNKNWPSMFKSKPCNNNHHHQQHESGSPSYMHYSNCNISSSFSSGIYKNLHHLLHSFFFDNCVYVKTCMMMIYTLYESDRVPDPKPRWNPKPEQIRILESIFNSGIVNPPREEIQRIRIRLQEYGQIGDANVFYWFQNRKSRAKHKLRVHHKSPKTSKKDKIISPGIDADHCFGLVHQETGLFPVQNNEMLVTQPAGYPSSVQNDLSVAQSGFGFGDFVVPVVREEGVAFPGNDESLDKIPAINFYGGDGNGGGGNCFSPLPLTTNQSQERAIVFHGGENVEDCVSPDKLTIFINDMLFEVAAGLFNVKEAFGNNAILINSFGQPILTDENGVTFQSLQNGAVYYLI

SEQ ID NO: 88 - protein, 288 aa, Camelina sativa
MKRNNKQEEDMKHRDSADCSFFFFFFFFFISLSLFMATRIPFTESQWEELENQALVFKYLAANVPVPPHLLFLIKRPFLFSSSSSSSSSSSPSSPSPSSFFSPTLSPHFGWNVYEMGMGRKIDAEPGRCRRTDGKKWRCSKEAYPDSKYCERHMHRGKNRSSSRKPPPPQFTPNLFLESSLSSSRVSRRRRSGYMDDFFSIEPSGSIKSCSGLAMEDDEGSCREKQPDRHCFILGTDLGTRERPLMLDEEKLKQRDDEDEEEQRSKRLYRFLDEWPSSKSSVSTSLFI

SEQ ID NO: 89 - protein, 370 aa, Camelina sativa
MSRKPCCVGEGLKKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRLVEQGIDPVTHKPLASNSNPTVHENLNSLNASSPDNQYSRSSSMPSLSLPLSGCNIVSEVTELSSNDGTPMQGGGTLRCKKIFNKSSSTSRLLNKVAAKATSIKDILSASMEGSLSATTISHASFFNGFSEQIRSEDDSSNASLTNLAEFDPFSQSSLYPEHDINATSDLDMGQDYDFSHFLEKLGVGNHDEENNMNVEYNHDLLMSDVSQEVSSTSVDDQDNMVGNFEGWSNYLLDHANFMYDTDSDSLEKHFI

SEQ ID NO: 90 - protein, 100 aa, Camelina sativa
MRKRQVVLRRSSPEEPSRSSSTASSLTVRTVRYGECQKNHAAAVGGYAVDGCREFMASRGEEGTLAALTCAACGCHRSFHRREIETEVVCDCNSPHSTGN

SEQ ID NO: 91 - protein, 384 aa, Camelina sativa
MKFTHYWSYIYRKKMSRKPCCVGEGLKKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRLVEQGIDPVTHKPLASNSNPTVHENLNTLNASSPDNQYSRSSSMPSLSPPLSGCNMVSEVTELSSNDGTPIQGGGSLSCKKNFKKSSSTSRLLNKVAAKATSIKDILSASVEGSLSATTISHASFFNGFSEQIRSEEDSSNASLTNLAEFDPFSQSSLYPEHEINATSDLDMGQDYDFSHFLEKLGVGNHDEENNMNVEYNHDILMSDVSQEVSSTSVDDQDNMVGNFEGWSNYLLDHANFMYDTDSDSLEKHFI

SEQ ID NO: 92 - protein, 265 aa, Camelina sativa
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRSRKVLPSPISLNNQLMYESINELQRKEKAIQEQNSMLSKQIKEREKILRAQQEQWDQQNHGHNMPPPPPPQQHQIQHPYMLSHQPSPFLNMGGLYQEEDPMAMRRNDLDLTLEPVYNCNLGCFAA

SEQ ID NO: 93 - protein, 100 aa, Camelina sativa
MRKRQVVLRRSSPEEPSRSSSTASSLTVRTVRYGECQKNHAAAVGGYAVDGCREFMASRGEEGTLAALTCAACGCHRSFHRREIETEVICDCNSPPSTGN

SEQ ID NO: 94 - protein, 238 aa, Camelina sativa
MGRGRVELKRIENKINRQVTFAKRRNGLLKKAYELSVLCDAEVALIIFSNRGKLYEFCSSSSSMLRTLERYQKCNYGAPEPNVPSREALAVELSSQQEYLKLKERYDALQRTQRNLLGEDLGPLSSKELESLERQLDSSLKQIRALRTQFMLDQLNDLQSKLADGYQMPLQLNPNPEDHLDPYGRHHHQQQHSQAFFQPLECEPILQIGYQGQQDGMGAGPSVNNYMLGWLPYDTNSI

SEQ ID NO: 95 - protein, 363 aa, Camelina sativa
MDNFFPFSSSNANSVQEFAMDANNNLSHITTMPTLYHHQAEPHHLLYSYPVEQMAAVMNPHQLLYSSDAFPQIPVSQPGSEFCSLVSNPNPCLRTERGGLFLDPTKMARINRKNAMIRSRNNSSPNSSPDEVVESKRQVMMLNMKNNVQIPVRTDLYPHSTFDNKKLRVLCVKLLKNSDVGALGRIVLPKREAEGKLPKLSDKEGIVLEMRDVFSLQSWSFKYKFWSNNKSRMYVLENTGEFVRQNGVESGDTLTIYEDESKNLYFAVTKPGRQNGGRGVESMEVNEMNHYEEIMYDFMPGDEEEASIAMLIGNLNDHYPNPNDLMGLTVDHQHHQAASSLPSVDYPHVGSLDDRVSFDDIVW

SEQ ID NO: 96 - protein, 154 aa, Camelina sativa
MNQGTYSDGSTSKFFKAYLPGESGDDLVLPISFNSCLQKSLPKTVTVSSVSGKIWNMVLRKRGGDYEAERFVMHIPAHVIKDYDLTFPERIKVVDKLGSLEKEIKIQVNGCVFVKGFGSVFRRNKMKTTDKMICEVKKTGTNLVHTIKVNIISG

SEQ ID NO: 97 - protein, 262 aa, Camelina sativa
MNPEEEGGSNKRKKRVMGRGKIEIKKIENQTARQVTFSKRRNGLIKKTRELAILCDAHMGLIVFSATGKLSEFCSENNKMPQLIDRYLQTTGLRLPDHHDDQEHLYHEMEALRREICNLELHLRPYHGHDLASIPPHELDGLERQLEHSVLKVRERKNELIQQQLENLSRKKRMLEEDNDNMCRWLHEHRAAIEFQQAGIETKPGEYLQFLEQLQYYNNDHQQQQQQPNSLLQLATLPSEIDPNYHLQLAQPNLQNDPAPKE

SEQ ID NO: 98 - protein, 744 aa, Camelina sativa
MSMAVEMSSKQPTKDFFSSPALSLSLAGIFRNASSGNTDPAEEDFLSRRVVDDEDRTVEMSSENSGPTRSRSEEDLEGEDHEEDLEDDDGNKGNKRKRKKYHRHTTDQIRHMEALFKETPHPDEKQRQQLSKQLGLAPRQVKFWFQNRRTQIKAIQERHENSLLKAELEKLREENKAMRESFSKAANSSCPNCGGGPDDLHLENSKLKAELDKLRAALGRTPYPLQASCSEDQEQRLGSLDFYTGVFALEKSRIAEIANRATLELQKMATSGEPLWLRSVETGREILNYDEYLKEFPQAQASSFPGRKTIEASRDVGIVFMDAHKLAQSFMDVGQWKEMFACLVSKAATVDVIRQGEGPSRIDGAIQLMFGEMQLLTPVVPTREVYFVRSCRQLTPEKWAIVDVSVSVEDSNTEKEASLLKCRKLPSGCIIEDTSNGHSKVTWVEHLDVSASTVHPLFRSLVNTGLAFGARHWVATLQLHCERLVFFMATNVPTKDSLGVTTLAGRKSVLKMAQRMTQSFYRAIAASSYHQWTKITTKTGQDMRVSSRKNLHDPGEPTGVIVCASSSLWLPVSPTLLFDFFRDEARRHEWDALSNGAHVQSIASLSKGQDRGNSVAIQTVKSREKSIWVLQDSSTNSYESVVVYAPVDINTTQLVLAGHDPSNIQILPCGFSIIPDGVESRPLVITTTQDDRNSQGGSLLTLALQTLINPSPAAKLNMESVDSVTNLVSVTLHNIRRSLQIEDC

SEQ ID NO: 99 - protein, 321 aa, Camelina sativa
MGRLPCCDESGLKKGPWTPEEDQKLINHIRKHGHGSWRALPKQAGLNRCGKSCRLRWTNYLRPDIKRGNFTAEEEQTIINLHSLLGNKWSSIAGHLPGRTDNEIKNYWNTHIRKKLIQMGIDPVTQRPRTDHLNVLAALPQLLAAANFNNLLNLNQSVQLDATSVAKAQLLHSMIQVLSNNNTSSSLETHHTNNNLFGQSSFLENLPSIGENLYDQTQSLSHIVNQPLDSFTSPIRVVAHQDQNSIPPLVSASPDESKQTQMMVKDKEILRHTDHTSNPSSTSTFTQDHQPWCDIIDDEASDSYWKEIIEQTCSEPWPFRE

SEQ ID NO: 100 - protein, 209 aa, Camelina sativa
MDNVSVFAKGENQLNGEKPPPQVCARCSSVNTKFCYYNNYNMSQPRYFCKECRRYWTQGGTLRNVPVGGGCRKPKRPRIEQSSVSQVATFENQPVNHQPLRLVHENNESVGLFGGSTSSSSSPAAVAAVLGKHLGYLAELRGVTNVPQVRGLRPVLLDRLDFVDQHKWNQSINNTMNVNHEASSSGSRGSSDTETNSNNDNKDQKYLFD

SEQ ID NO: 101 - protein, 187 aa, Camelina sativa
MFKEKIYQIGQNSLQMYQDSFGGTMGRRKVTHQLIADHATRRVTFRKRKDGLLKKINELTILCGLPACAIIYSEYKDGPELWPNVNEVRSLLDRLSELPVEKQTKYMMDQKDLMKKMIQDAEKKLEKEKWYTRAMKLGIMASTSDLTTDTDCSEELAKAAEVVDKKLKAIRERIKAVEAGAPIIKRE

SEQ ID NO: 102 - protein, 219 aa, Camelina sativa
MNPEEEGGSNKRKKRVMGRGKIEIKKIENQTARQVTFSKRRNGLIKKTRELAILCDAHIGLIVFSATGKLSEFCSENNKMPQLIDRYLQTNGLRLPDHQDDQAQLYHEMEALRREICNLELHLRPYQGHDLASIPPHELDGLERQLEHSVLKVRERKNELMQQQLENLSRKKRMLEEDNDNMCRWLHEHRAAIEFQQAGIETKPGEYVQFLEQLQYYNN

SEQ ID NO: 103 - protein, 254 aa, Camelina sativa
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSSKELESLERQLDSSLKQIRALRTQFMLDQLNDLQSKERMLTETNKTLRLRLADGYQMPLQLNPNPEDHVDLYGRHHQQQQQQQQHSQAFFQPLECEPILQIGYQAQQDGMGAGPSVNNYMLGWLPYDTNSI

SEQ ID NO: 104 - protein, 251 aa, Camelina sativa; identical to SEQ ID NO: 86

SEQ ID NO: 105 - protein, 1127 aa, Camelina sativa
  misc_feature (395)..(395): Xaa can be any naturally occurring amino acid
MSMAVEMSSKQPTKDFFSSPALSLSLAGIFRNASSGNTDPADEDFLSRRVVDDEDRTVEMSSENSGPTRSRSEEDLEGEDHDEDLEDDDGNKGNKRKRKKYHRHTTDQIRHMEALFKETPHPDEKQRQQLSKQLGLAPRQVKFWFQNRRTQIKAIQERHENSLLKAELEKLREENKAMRESFSKAANSSCPNCGGGPDDLHLENSKLKAELDKLRAALGRTPYPLQASCSEDQEQRLGSLDFYTGVFALEKSRIAEIANRATLELQKMATSGEPLWLRSVETGREILNYDEYLKEFPQAQASSLPGRKTIEASRDVGIVFMDAHKLAQSFMDVGQWKEMFACLVSKAATVDVIRQGEGPSRIDGAIQLMFGEMQLLTPVVPTREVYFVRSCRQLXTKDFFSSPALSLSLAGIFRNASSGNTDPADEDFLSRRVVDDEDRTVEMSSENSGPTRSRSEEDLEGEDHDEDLEDDDGNKGNKRKRKKYHRHTTDQIRHMEALFKETPHPDEKQRQQLSKQLGLAPRQVKFWFQNRRTQIKAIQERHENSLLKAELEKLREENKAMRESFSKAANSSCPNCGGGPDDLHLENSKLKAELDKLRAALGRTPYPLQASCSEDQEQRLGSLDFYTGVFALEKSRIAEIANRATLELQKMATSGEPLWLRSVETGREILNYDEYLKEFPQAQASSLPGRKTIEASRDVGIVFMDAHKLAQSFMDVGQWKEMFACLVSKAATVDVIRQGEGPSRIDGAIQLMFGEMQLLTPVVPTREVYFVRSCRQLTPEKWAIVDVSVSVEDSNTEKEASLLKCRKLPSGCIIEDTSNGHSKVTWVEHLDVSASTVQPLFRSLVNTGLAFGARHWVATLQLHCERLVFFMATNVPTKDSLGVTTLAGRKSVLKMAQRMTQSFYRAIAASSYHQWTKITTKTGQDMRVSSRKNLHDPGEPTGVIVCASSSLWLPVSPTLLFDFFRDEARRHEWDALSNGAHVQSIASLSKGQDRGNSVAIQTVKTREKSIWVLQDSCTNSYESVVVYAPVDINTTQLVLAGHDSSSIQILPCGFSIIPDGVESRPLVITTTQDDRNSQGGSLLTLALQTLINPSPAAKLNMESVDSVTNLVSVTLHNIKRSLQIEDC

SEQ ID NO: 106 - protein, 394 aa, Camelina sativa
MDLQLKQWRSQQQNESEEQGSATKISNFFFDQIQSQTATSAAAAAPLPLFVPEPTSSSSFSCFSPDSSSSSSSKFLKVGNLFSWTQWQELELQALIYRYMLAGASVPQELLLPIKKSLIHQSPMHFLHHPLQHSFPHQQPSWYWGRGAMDPEPGRCKRTDGKKWRCSRDVVAGHKYCDRHIHRGRNRSRKPVETTTTTTTTTTTATTAAPSFVLGEELGHAHGHGPNNNHFFSSGSSQHLQLNHQQSCSSEMKQESNNNSNNHKRPYEAHNGFSNGRSDDGHILRHFFDDWPRSSDSTSSPMSSSNCHLSISMPGNGNTSSDVSLKLSTGNEEEEENMRNNNNNNNSEREQLNWWSNGGNHHNNMGGPLAEALRSASSTPSVLHQMGISTQVFH

SEQ ID NO: 107 - protein, 363 aa, Camelina sativa
MDNFFPFSSSNANSVQEFAMDANNNLSHLTTMPTYDHHQAEPHHLLYSYPVEQMAAVMNPHQPLYSSDAYPQIPVSQTGSEFCSLVSNPNPCLRPERGGLFLDPTKMARINRKNAMIRSRNNSSPNSSPDEVVDSKRQVMMLNMKNNVQIPERKDHYPHSTFDNKKLRVLCVKLLKNSDVGALGRIVLPKREAEGKLPKLSDKEGIVLEMRDVFSLQSWSFKYKFWSNNKSRMYVLENTGEFVRQNGVESGDTLTIYEDESKNLYFAVTKPGRQNGGRGVESMKVNEMNHYEEIMYDFMPGDEEEASIAMLIGNLNDHYPNPNDLMGLTIDHQHHQAASSLPSVDYAHVGSLDDQVSFDDIGW

SEQ ID NO: 108 - protein, 336 aa, Camelina sativa
MEAFGGFHKEDDEQMDLPPGFRFHPTDEELITHYLHNKVLDMAFSAKAIGEVDLNKAEPWELPYKAKMGEKEWYFFCVRDRKYPTGLRTNRATQAGYWKATGKDKEIYRGKSLVGMKKTLVFYRGRAPKGLKTNWVMHEYRLDGKLSAHNLPKTAKNEWVICRVFHKTAGGKKIPISTLIRIGSYGTGSSLPPLTDSSTYNDKTKTEPVYVPCFSNQAETRGTTLLNSFSNSSLSSSMQPDFLQMIPLYQPHQSLNVSENLQSSNPVLTQEQSVLQAMIENNKRMSFKTLNINSRETGASNTDHSSVFEFGRKRFDHQEVPSSSAGPLNLEPFWNY

SEQ ID NO: 109 - protein, 324 aa, Camelina sativa
MGRSPCCDESGLKKGPWTPEEDQKLINHIRKHGHGSWRALPKQAGLNRCGKSCRLRWTNYLRPDIKRGNFTAEEEQTIINLHSLLGNKWSSIAGHLPGRTDNEIKNYWNTHIRKKLIQMGIDPVTHRPRTDHLNVLAALPQLLAAANFNNLLNLNQSVQLDATSVAKAQLLHSMIQVLSNNNTSSSLETHHTNTNNNLFGQSSFLENLPNIGENLYDQTQSLSHIVNQPLDSFTSPMRVVAHQDDQNSIPPLVSASPDESKQTQMMVKDKEILRHTDHTSNPSSTSTFTQDHQPWCDIIDDEASDSYWKEIIEQTCSEPWPFRE

SEQ ID NO: 110 - protein, 338 aa, Camelina sativa
METFCGFQKEEEQMDLPPGFRFHPTDEELITHYLHKKVLDISFSAKAIGEVDLNKSEPWELPWMAKIGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPTLLPSLTDSSPYNDKTKTEPVYVPCFSNQTDQNQGTTTLNCFSSPALNSIQADIFRRIPLYQTQSLQVSTNLLHSPILAQEHSVLHAMIENNRRQSHKTMSVSQETGVSTDMNTDISSDFEFGKRRFYPQEDPSSSTGPVDLEPFWNY

SEQ ID NO: 111 - protein, 163 aa, Camelina sativa
MGRRKVTHQLIADNATRRVTFRKRKDGLLKKINELTILCGLPACAIIYSEYKDGPELWPNVNEVRSLLDRLSELPVEKQTKYMMDQKDLMKKMIQDAEKRLEKEKWYTRAMKLGIMASTSDLTTDTDCSEELAKAAEVVDKKLKAIRERIKAVEAGAPIIKRD

SEQ ID NO: 112 - protein, 369 aa, Camelina sativa
MESTDSSGGPPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKLNNRPPGCDFGNKKNSLRLDDWVLCRIYKKNNAGRHVDNDKDHDMIDYIFRKIPPSLSMAAAATGLHHHNHNVSRSMNFFPGRFSGGGYGIFPDGNNASLYDGGGMGMINNNMGTDSLDHHDNNNVDVVGLNHASSSVPMMMMANQKRPLPVPYWPVAEEEQDASPSKRFHGGGGDCSNMSSSMMEETPPMMQQQGGGVLGDGLFRTTPYQLPGLNWYPS

SEQ ID NO: 113 - protein, 305 aa, Camelina sativa
LVFHSLYFHLFSLSLYLPLWYIIHSNPTIKKIRSWWGFLFSPYQESSDQSNTHQSIKSPNTPKKRSASNFFLFLTKKMSMSSMSSPSSAVFSPDHLSPSDHLCYVQCNFCDTILAVSVPYTSLFKTVTVRCGCCTTLLSVNMRLVLPASNQLQLQLGPHSYFNSQNIMEELRDAPSNMNMMMMNQHSNMNDIPSFMDLHQQHEIPKAPPVNRPPEKRQRVPSAYNRFIKEEIQRIKAGNPDISHREAFSAAAKNWAHFPHIHFGLVPDNQPVKKTNMPQQEGEDNNMVMKDGFYAPAANVGVTPY

SEQ ID NO: 114 - protein, 227 aa, Camelina sativa
MSMSSMSSPSSAVFSPDHLSPSDHLCYVQCNFCDTILAVSVPYTSLFKTVTVRCGCCTTLLSVNMRLVLPASNQLQLQLGPHSYFNSQNIMEELRDAPSNMNMMMMNQHSNMNDIPSFMDLHQQHEIPKAPPVNRPPEKRQRVPSAYNRFIKEEIQRIKAGNPDISHREAFSAAAKNWAHFPHIHFGLVPDNQPVKKTNMPQQEGEDNMVMKDGFYAPAANVGVTPY

SEQ ID NO: 115 - protein, 514 aa, Camelina sativa
MLVQTIPVAFFLKYIKGRDEQKKTARLRSDASKIIWNVKLDGKRLTDGWKEFALAHNLRIGDIVIFRQERDLAFYVTLLGPSCCEIRYGSCLEEETNLEKKKEKKSPNEDSCFVANVAPSSLRYDSLLFPKAFVRENGVVTGSGEIVLMNEKGRSWTLKMKQKPSCGTIYVRGGWINFCDANGLKSGDTVTFKLIQRGRTRVLRLLAKESKQEANDVSLSTEPESDEDSNIGKIQRQRKMKKSPRRDTESSSSLDPSCFVASIAPSSLRYDTMYLPKKFMRENGIYTKHGEIILMNQKGRSWTLDLKRKKWCGTFCIKRGWKSFCRANGLSAGSIITFKLIKKRGTLTLRLIPNEGEEEEEISEANKVESLSRDQESDEESSHDEKISQECSRRNEKKRRLRWIASSSPSKNRFVTLTLTPYNVSASVLRLPIPFTRMNGIDKETKMTLLDKQGKKWSTKLHLEDDKSKRLRMVGGWKGFLQANCVKANESIRLELIWEEEKSCVLKFRSKVNL

SEQ ID NO: 116 - protein, 247 aa, Camelina sativa
MEEGGSSHEADSSKKIGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNEMLVAEIEYMQKREMELQHDNMYLRAKIAEGARLNPDQQESNVIQGTTVYESGVSSHQSHHYNRNYIPVNLLEPNQQFSVQDQPPLQLV

SEQ ID NO: 117 - protein, 300 aa, Camelina sativa
LLSPFTFSLSLYLPLWYIIHSNPTIKKIRSWWGFLFSPYQESSDQSNTHQSIKSPNTPKKRSASNFFLFLTKKMSMSSMSSPSSAVFSPDHLSPSDHLCYVQCNFCDTILAVSVPYTSLFKTVTVRCGCCTTLLSVNMRLVLPASNQLQLQLGPHSYFNSQNIMEELRDAPSNMNMMMMNQHSNMNDIPSFMDLHQQHEIPKAPPVNRPPEKRQRVPSAYNRFIKEEIQRIKAGNPDISHREAFSAAAKNWAHFPHIHFGLVPDNQPVKKTNMPQQEGEDNMVMKDGFYAPAANVGVTPY

SEQ ID NO: 118 - protein, 503 aa, Camelina sativa
MDGGEETTTTTAMEARGLKKGPWTATEDAILTEYVRKHGEGNWNAVQKNSGLLRCGKSCRLRWANHLRPNLKKGSFTPDEEKIIIELHAKLGNKWARMASQLPGRTDNEIKNYWNTRMKRRQRAGLPLYPHDTQHQHDHQGIDDNDDDEFEFDLSSFQFQNQDLLHHNQQNMIQYTNSSNTSSSISSSSFSSSSSQPSKKMRPNDPLVSTNPGLNPIPDSPMNFQMFSLYNNSLDQNDSSHFGFSLPLSSSSSSNEFCNPNHILEYISENSDTSNYHKKDIDALSYSSLLLMGDHEVRPSSFPLGLENTVLELPSNQTTIDSFTSNPILDNGVHLEPPAGNSGLLDALLEESQALSRGGLFKDVRVSSSDLCKVQEERMKTDFENRLKDHLNSSDQPSLGANPNIHKYNEPTMVKATVDDDDDLLMSLLNNFPSTTTPLPDWYRMTEIQNEASYLAPPSGSILMGTYQGNSREEEPATVSPSSSVDPVASLGTCYWSNMPRIC

SEQ ID NO: 119 - protein, 495 aa, Camelina sativa
  misc_feature (78)..(78): Xaa can be any naturally occurring amino acid
MDGGEETTTTTTAMEARGLKKGPWTATEDAILTEYVRKHGEGRTDNEIKNYWNTRMKRRQRAVPFSSKTKIFFIITNXELHAKLGNKWARMASQLPGRTDNEIKNYWNTRMKRRQRAGLPLYPHDTHQHHQGIDDNDDNDEFEFDLSSFQFQNQDLLHHNQQNMIQYTNSSNTSSSISSSSFSSSSSQPSKKMRPNDPLVSTNPGLNLIPDSPMNFQMFSLYNNSLETDNINSHFGFSLPLSSSSSSNEFCNPNHILEFISENSDTSNYHKKDIDALSYSSLLMGDHEMRPSSFPLGLENTVLELPSNQTTIDSFSSNPIPDNGVHLEPPAGNSGLLDALLEESQALSRGGLFKDVRVSSSDLCKVQEERMKMDFENRLTDHLNSSHQSSLGANPKIHKYNEPTMVKATVDDDDDLLMSLLNNFPSTTTPLPDWYRMTEIQNEASYLAPPSGSILMGTYQGNSREEEPATVSPSSSVDPMASLGTCYWSNMPRIC

SEQ ID NO: 120 - protein, 266 aa, Camelina sativa
MRMSCNGCRVLRKGCSEDCSIRPCLSWIKSPEAQANATVFLAKFYGRAGLMNLINAGPDHLRPGIFRSLLHEACGRIVNPIYGSVGLLWSGNWQLCQDAVEAVMKGEPITEIATDAATIGQGPPLKSYDIRHNSKDDNSAAAAATGSTDLKRGKPRRAKRIAALEKQAESEGKSGGGEASHDSSLSHQSEVVAAHEGESKESESDASEVLAFSPPAVQGSGDIKLDLTLGLEPVSRAYDVAPVKKRRIGVFATCQKESTCKTELML

SEQ ID NO: 121 - protein, 238 aa, Camelina sativa
MENELDLTLKLGLPNSTVVETHLSLNTSTTTSTITDQGTINTNVVVDGGRGDHNNNNEGSRGGISNDGGEVFNLRRSLRGDHEVINDQGARSNVDMNIRVYNYIFQQFVGVPNTLNVGPYPMPPSPRSTPALAVTPEFVLIDVPARRASRNNTELMANAWNETPSAHAKRLRGCDGYYRGGRGGGRGEGTLRKCTNVNCNALTTPMWRRGPLGPKSLCNACGIKFRKEEERKSKRNRE

SEQ ID NO: 122 - protein, 253 aa, Camelina sativa
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSSKELESLERQLDSSLKQIRALRTQFMLDQLNDLQSKERMLTETNKTLRLRLADGYQMPLQLNPNPEDHIDPYGRHHHQQQQQHSQAFFQPLECEPILQIGSYQAQQDGMGAGPSVNNYMLGWLPYDTNSI

SEQ ID NO: 123 - protein, 217 aa, Camelina sativa
MKKTLVFYRGRAPRGEKTNWVMHEYRLEGKYSYHNLPKSARDEWVVCRVFHKNNPSTTTQPMTRIPIENLTRTDSLENIDHLLDFSSLPPLIDPSFTSQTEQPNFKPINPPTYNISSPIQPHHFNSYQSMFNHQDFGSASASGSTYNNNNDMIKVEQSLVSVSQETCLSSDVNVTTTATTEVSSGPVMKQEMGMMGMVNGSKSYEDLCDLRGFLWDY

SEQ ID NO: 124 - protein, 337 aa, Camelina sativa
MAVVVEEGVVLNHGGEELVDMPPGFRFHPTDEEIITCYLKEKVLNSRFTAVAMGEADLNKCEPWDLPKRAKMGEKEFYFFCQRDRKYPTGMRTNRATESGYWKATGKDKEIFRGKGCLVGMKKTLVFYRGRAPRGEKTNWVMHEYRLEGKYSYHNLPKSARDEWVVCRVFHKNNPSTTTQPMTRIPIEHLTRTDSLENIDHLLDFSSLPPLIDPSFTSQTEQPNFKPINPPTYDISSPIQPHHFNSYQSIFNHQGFGSASASGSTYNNNNDMIKMEQSLVSVSQETCLSSDVNVTTTATTEVSSGPVMKQEMGMMGMVNGSKSYEDLCDLRGFLWDY

SEQ ID NO: 125 - protein, 330 aa, Camelina sativa
MGRSPCCDENGLKKGPWTQEEDEKLIVHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLLAAANLNSLLNLNQNVQLDATTLAKAQLIHNMIQVLSTNNNTNPSFSSSTMQTNNNNLFGQSSYLENQNIFGQSQTFSHILENSHDNPLDSLTSGPIQPDFQDDHNSLPLLVPASPDEESKQTQTMIKNKDIAEYHHPDHNTNPSSSNSTFTQDHHQPWCDVIDDGASDSYWKEIIEQTCSEPWPFPE

SEQ ID NO: 126 - protein, 324 aa, Camelina sativa
MENMGDSSIGPGHPHLPPGFRFHPTDEELVVHYLKKKATSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTTAKPPDIATTRKNSLRLDDWVLCRIYKKNSSQRPTMERVLLREDLMEGMLSKSSANSSSTSVLDNNDNNNNNNNEEHFFDGMVVSSDKRSLCGQYRMGHEASGSSSFGSFLSSKRFHHTGDLNNDNYNVSFVSMLSEIPQSSGFHANGVMDTTSSLGDHGVLRQAFQLPNMNWHS

SEQ ID NO: 127 - protein, 336 aa, Camelina sativa
MAVVVEEGVVLNHGGEELVYLPPGFRFHPTDEEIITYYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPRGEKTNWVMHEYRLEGKYSYHNLPKSARDEWVVCRVFHKNNPSTTTQPMTRIPIEDLTRMDSLENIDHLLDFSSLPPLIDPSFTSQTEQPNFKPINPPTYDISSPIQPHHFNSYQSIFNHQGFGSASASGSTYNNNNDMIKMEQSLVSVSQETCLSSDVNVTTTATTEVSSGPVMKQEMGMMGMVNGSKSYEDLCDLRGFLWD

SEQ ID NO: 128 - protein, 188 aa, Camelina sativa
MNLPPGFRFFPTDEELVVHFLHRKASLLPCHPDVIPDLDLYPYDPWDLPGKALGEGRQWYFYSRKTQDRLTSNGYWGSMGMDEPIYTSSTHKKVGIKKYLTFYLGDSQTNWIMQEYSLPDSSSSSSRSSKRSSRASSSSSHKPDYSKWVICRVYEQNCSEEEEDDETELSCLDEVFLSLDDLDEVSLP

SEQ ID NO: 129 - protein, 253 aa, Camelina sativa
MKFDKVGSIKDLPSLPAGVKFDPSDKEILMHLEAKVSSDKRKLHPLIDEFIPTLEGENGICYTHPEKLPGVSKDGQVRHFFHRPSKAYTTGTRKRRKVSTDEEGHETRWHKTGKTRPVMSQSGEAGFKKILVLYTNYGRQKKPEKTNWVMHQYHLGNSEDEKDGEPVLSKVFYQTQPRQCGNSTEPKPKNLVNLNRFSYENTQTGFGYEHGGKSEEASQVIRELVVHEGDGSCSFLRFTCDASKGKESFMKNQ

SEQ ID NO: 130 - protein, 233 aa, Camelina sativa
LLYLLYIPQSLSHTSSGSTSSSLYNLLLHTHTHTHTHATTYISSSMDLPPGFRFFPTDEELVVHFLHRKASLLPCHPDVIPDLDLYPYDPWDLPGKALGEGRQWYFYSRKTQDRVTSNGYWGSMGLDEPIYTSSTHKKVGIKKYLTFYLGDSQTNWIMQEYSLPDSSSSSSRSSKRSSRASSSSSHKPDYSKWVVCRVYEQNCSEEEDDDGTELSCLDEVFLSLDDLDEVSLP

SEQ ID NO: 131 - protein, 331 aa, Camelina sativa
MGRSPCCDENGLKKGPWTQEEDEKLIVHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLLAAANLNSLLNLNQNVQLDATTLAKAQLIHNMIQVLSTNNNTNHPSFSSSTMQTNNNDLFGHSSYLENQNIFGQSQTFSHILENNHDNPLDSLASGPIQPDFQDDHNSLPLLVPASPDEESKQTQMMVKNKDIAEYHHPDHTTNPSSSNSTFTQDHHQPWCDVIDDGASDSYWKEIIEQTCSEPWPFPE

SEQ ID NO: 132 - protein, 470 aa, Camelina sativa
QRRSKKKKGSFIFTSEAKQIRDFCCGCLCLLSQTLSRNKKISELRKKKKNYPKSNQHISLSLFLSLSLTLSFVSMDLQLKQWRSQQQNESEEQGSATKISNFFFDQIQSQTAATSGAAAAAPLPLFVPEPTSSSSFSCFSPDSSSSSSKFLKIGNLFSWAQWQELELQALIYRYMLAGASVPQELLLPIKKSLIHQSPMHFLHHPLQHSFPHQQPSWYWGRGAMDPEPGRCKRTDGKKWRCSRDVVAGHKYCDRHIHRGRNRSRKPVETATTTTTTTTTTTATTAAPSFVLGEELGHGHRPNNNHFFSSGSSQHLQLNHQQSCSSEMKQENNNNSNNHKRPYEAQNGFSNGRSDDGHILRHFFDDWPRSSDSTSSPMSSSNCHLSISMPGNGNTSSDVSLKLSTGNEEEEEENMRNNNNNNNNEREQLNWWSNGGNHHNNMGGPLAEALRSASSTPSVLHQMGISTQVFH

SEQ ID NO: 133 - protein, 255 aa, Camelina sativa
MATRIPFTESQWEELENQALVFKYLAANVPVPPHLLFLIKRPFLFSSSSSSSSSSPLPSSFFSPTLSPHFGWNVYEMGMGRKIDAEPGRCRRTDGKKWRCSKEAYPDSKYCERHMHRGKNRSSSRKPLPLTPPPQFTPNLFLESSLSSSRVSRRRRSGYMDDFFSIEPCGSIKSCSGSAMEDDEGSCREKQPDRHCFILGTDLGTRERPLMLDEEKLKQRDDDDEDEEEQRSKRLYRFLDEWPSSKSSVSTSLFI

SEQ ID NO: 134 - protein, 647 aa, Camelina sativa
FFKECPHPDDKQRRDLGRQLGLAPVQIKFWFQNKRTQNKNHQERCENTELRSLNSKLRSENERFREAVFLALCPKCGGKTAIGEMSFEEHHLRIVNARLNEEINELTALAVKFSSKSVISYPVMSPRPSNRPPTFEFGAGSSSESGGNFSRGITGTADADTPMVMELAIGAMEELLLMAQVGEPLWMGGVDGTSLALNLDEYARTFRKGLGPRLSGFRIEASRETALVAMNPTGVVEMLMQANLWSTMFVGMVGRAITHEKLLTDVAENFNGALQIMSAEYQVLSPLVSTRESYFVRYCKQQGENLWAVVDVSIDHLLPNTHMKCRRRPSGCLIQEIPNGYSKVTWVEHVEVNDREANQNIFKHFISSGQAFAANRWVATLERQCERIASIMTTDFQSVDSPDHLVLTEHGKTSILKLAERVARSFFVGLTSSMGTTFSGVGGDDIRMMTMKNINDPGRPPGVVFSAATSFWVPAPPKIVFDFLRDVDHRASWDVLCAGGVVHKISEIANGRDSRNCATLLRNEIPFEKKMMIIQETSTDPTASFVIYAPVDTESIEGVLSAGQDPDYVALLPSGFAILPDGMGDQPGGNGGGGSLLTVSFQMLVEGVDLGKLSITSVATVENLIRTTVLRIKALFPFQIATPSLGK

SEQ ID NO: 135 - protein, 266 aa, Camelina sativa
MRMSCNGCRVLRKGCSEDCSIRPCLSWIKSPEAQANATVFLAKFYGRAGLMNLINAGPDHLRPGIFRSLLHEACGRIVNPIYGSVGLLWSGNWQLCQDAVDAVMKGESITEIATDAATIGQGPPLKSYDIRHNSKDDNSAAAAATGSTDLKRGKTRRAKRVAALEKQAESEGKSGGGEASHESSLSHQSEVVAAHEGESKESESNASEVLAFSPPAAQGSGEVKLDLTLGLEPVSRAYDVVPVKKRRIGVFGTCQKESTCKTELML

SEQ ID NO: 136 - protein, 430 aa, Camelina sativa
MLRVSACDVRQLPSPTNSDHNKTVNTSKKHQRPTEEGGDVQENAVLVRAKRGRKTKSIPEESWDNSSFFAFVTASNLEADALYLPQDFTSSSGLPKFFCKVVLTDGRGNSWELELRYDKSSNSFYMSRGWRHFCDELGKKVGSVFTFELMKEWGTPFLSFSPSKATLCYETSENLDHFVTLNLSYDSLKNCRLYLPSGNMRRNGLDESRLVTLLGKDGTRTIANLVRETSGRNFGRLSLGKAWREFALANNLEVGENFTLECIWENATPILRLSDTKPRRYIKRGPKPKFSGFCKKVSASSAAKDGKEREKGKNIEEPINEASLIENHLLVILPLLHEDVKAYTLFLPSQFMKANGIDILFGKILLLGRKESEWCGCLLSRDGNVSVGYGWRNFCEANGVKIGDSFSLEFKHNVDNIPVLQFRPKLRSGE

SEQ ID NO: 137 - protein, 319 aa, Camelina sativa
MGRSPCCDENGLKKGPWTQEEDEKLIVHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLLAAANLNSLLNLNQNVQLDATTLAKAQLIHNMIQVLSTNTNTNHPSFSSSTMQTNNNNLFGQSSYLENQNIFGQSQTFSHILENNHDNPLDSLASGPIQPDFQDDHNSLPLLVPASPEESKQTQTMIKNKDIAEYHHPDHTTNPSSSNSTFTQDHHQPWCDVIDDGASDSYWKEIIE

SEQ ID NO: 138 - protein, 448 aa, Camelina sativa
MQSSFKTVPFNPDFYSQSSYFFRGDTCLEEFHQPVNGFHHDEPLDLSPNVTIASSANLHYTTFDTGMDCGGLRKRLEVEGECLDTGQLVYQKGTRLVAGGVGGGGGGEVNGSLENWCDSVSAMADNSQHTDTSTDIDTDDKTQLNGVHQGVVLATNCSDQSKTLRRLAQNREAARKSRLRKKAYVQQLENSRVRLAQLEEELKRARQQGSVVESGVTANHTHLPAGNGAFSFELEYTRWKEEHQRLINDLRSGVNSQLGDNELRMLVDAVMSHYNEIFRLKGIGTKVDVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 139 - protein, 310 aa, Camelina sativa
MDMRSHEMIERRRDDNGNNNGGVISNIISTNDDNCNGNNNNNNTRVSCNSQTLDHHQSKSPSSFSISAAVKSSTVRYRECLKNHAANVGGSVHDGCGEFMPSGEEGTIEALRCAACDCHRNFHRKEIDGVGSSDLVSHHRHHHHHHNQYGGGGGGRRPPPQNMMLNPLMLPPPPNYQPIHHHKYGMSPPGGGGMVTPMSVAYGGGGGAESSSEDLNLYGQSSGEGAGAAAGGQMAYSMSSSKKRFRTKFTTEQKERMMEFAEKLGWRMNKQDEEELKRFCGEIGVKRQVFKVWMHNNKNNAKKPPTPTTL

SEQ ID NO: 140 - protein, 266 aa, Camelina sativa
MRMSCNGCRVLRKGCSEDCSIRPCLSWIKSPEAQANATVFLAKFYGRAGLMNLINAGPDHLRPGIFRSLLHEACGRIVNPIYGSVGLLWSGNWQLCQDAVEGVMKGEPITEIATDAATIGQGPPLKSYDIRHNSKDDNSAAAAATGSTDLKQGKTRRAKRVAALEKQSESDGKSGGGEASHESSLSHQSEVVAGHEGESKESESNASEVLAFSPPAVQGSGEIKLDLTLGLEPVSREYDVVPVKKRRIGVFGTCQKESTCKTELVL

SEQ ID NO: 141 - protein, 253 aa, Camelina sativa
MGRAPCCEKMGMKRGPWTPEEDQILINYIHLYGHSNWRALPKHAGLLRCGKSCRLRWINYLRPDIKRGNFTPQEEETIINLHESLGNRWSAIAAKLPGRTDNEIKNVWHTHLKKRVNKKQNNGGDTKDINGINETSQTTTHDEDKESMIVETTSPQQFSSSITTFDISNNHIMSYEDISALVDESFWSDFVSVDNSNHHKEKKLEEDWEVLLDRNIKRNSYNNSELYDDDMEFWFELFTSNRRIEEFSDIPEC

SEQ ID NO: 142 - protein, 351 aa, Camelina sativa
VTLIIEKLLAVNLLRLLQEREENHSSYFCCLELDDKKKMEDNLPPGFRFHPTDEELITHYLGRKVSDTGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVFEKSTATKKAQEQQPQSSQPSFGSPCDANSSMANEFEDIEIPNLNSNSSTIDYNNHIHQYSQRNVYSEDNSTSTAGVNMNMNMASTNLPSWTTSLLGPPLSPINSLLLKAFQIRNTYGFPKEMIPNFNPSSLQQGGSNTMQNGSSSSHVQPQPQEEAFNMDSIW

SEQ ID NO: 143 - protein, 216 aa, Camelina sativa
VTLIIEKLLAVNLLRLLQEREENHSSYFCCLKLEDNKKMEDNLPPGFRFHPTDEELITHYLVRKVSDTGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHERNGLYVGYSKRARQRRKHKNNNLNLHNHLLDLHAMRIHQWQMNLKISRFRI

SEQ ID NO: 144 - protein, 337 aa, Camelina sativa
MGRSPSCDDSGLKKGPWTPDEDEKLVNYVQEHGHSSWRALPKLAGLNRCGKSCRLRWTNYLRPDIKRGRFSPDEEQTILNLHSVLGNKWSTIANQLPGRTDNEIKNFWNTHLKKKLIHMGIDPMTHRPRTDIFTGLSQLMSLSSNLRGYVDLQQQFPIDQDHHTILKLQTEMAKIQLFQYLLQPSSFMNSVNPNDLDSLSLLNSIASFKETNSNNLDHLGCLGSYLQDFNSLPPLKTLNSNMEPSSVYPQNPDDNHFKFFTQRENLPVSPVWLSDPSISTQSLMPSCVVTDDLIRNQYGVEDVNSNITSSSGQESAASASAAWPDHLLDDSIFSDIP

SEQ ID NO: 145 - protein, 347 aa, Camelina sativa
MLDLNLKIFSSYDENQDRKVPFMISTTGEEESNSSSSNSSTTDSAAGDAFITFGILKRDDDVTPPPPPPKETGDLFPVADARRSIEFSVEDSHWLNLSSLQRNTQKVLKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNAHNDLELSLGISSSSENMKLTTGDNYKGINWSTMGLFGKQPSIYLPMTTATMKPLKTVAASSGFPFISMTTSSSSMSTCFDP

SEQ ID NO: 146 - protein, 307 aa, Camelina sativa
MDMRSHEMIERRRDDNGNNGGVISNIITTNDDNCNGNNNNTRVSCNSQTLDHHQSKSPSSFSISAAVKSSTVRYRECLKNHAATVGGSVHDGCGEFMPSGEEGTIEALRCAACDCHRNFHRKEIDGVGSSDLIPHHRHHHHHHHNQYGGGGGGRRPPPQNMMLNPLMLPPPPNYQPIHHHKYGMSPPGGGGMVTPMSVAYGGGGGAESSSEDLNLYGQSSGEGAGAAAGQMAYSMSSSKKRFRTKFTTEQKERMMEFAEKLGWRMNKQDEEELKRFCGEIGVKRQVFKVWMHNNKNNAKKPPTPTTL

SEQ ID NO: 147 - protein, 341 aa, Camelina sativa
MGRSPSSDDSGLKKGPWTPDEDEKLVNYVQEHGHSSWRALPKLAGLNRCGKSCRLRWTNYLRPDIKRGRFSPDEEQTILNLHSVLGNKWSTIANQLPGRTDNEIKNFWNTHLKKKLIHMGIDPMTHRPRTDIFTGLSQLMSLSSNLRGYVDLQQQFPVDQDHHTILKLQTEMAKIQLFQYLLQPSSFMNSVNPNDLDSLSLLNSIASFKETNSNNLDQLGCLGSYLQDFNSLPPLKTLNSNMEPSSVYPQNPDDNHFKFFTQRENLPVSPVWLSDPSISTQSLLPSLGPSSVVTDDLIRNQYGVEDVNSNITSSSGQESAASASAAWPDHLLDDSIFSDIP

SEQ ID NO: 148 - protein, 191 aa, Camelina sativa
MSQQRMKLSPPPPLANNEQSSTASAVKSFGGGGGRATSSTTRHPVYHGVRKRRWGKWVSEIREPRKKSRIWLGSFPVPEMAAKAYDVAAFCLKGRKAQLNFPDEIDDLPRPSTCTARDIQVAAAKAANAVKIIEMVDVDDVADEDDFWEGIELPELMMTGGGWSPEPFVAGDDATWLVDGDLYQYQFMACL

SEQ ID NO: 149 - protein, 328 aa, Camelina sativa
MDGVYNFHSAGDYTDKAVLMMSPEILMFPSDYQALLCSSAGENRVSDVFGSDELLSAAASALSSEAASIAPEIRRNDDNVSLSVIKTKIACHPSYPRLLQAYIDCQKVGAPPEIACLLEEIQRESDVYKRDVVPLSCYGADPELDEFMETYCDILVKYKSDLARPFDEATSFLNKIEMQLRNLCTGVDSARNNVSEDGAISSDEELSGGDHEVAEDGKQRCEDRDLKDRLLRKFGSRISSLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 150 - protein, 254 aa, Camelina sativa
MGRAPCCEKMGMKRGPWTPEEDQILINYIHLYGHSNWRALPKHAGLLRCGKSCRLRWINYLRPDIKRGNFTPQEEETIINLHESLGNRWSAIAAKLPGRTDNEIKNVWHTHLKKRVNKKQNNGGDTKDINGINETSQTTKHDEDKESMIVETTTSPQQFSSSITTFDISNNEIMSYEDISALVDESFWSDFVSVDNSNHHKEKKLEEDWEGLLDRNIKINSYNNSELYNDDMEFWFELFTSNRRIEEFSDIPEC

SEQ ID NO: 151 - protein, 309 aa, Camelina sativa
MDMRSHEMIERRRDDNGNNGGVISNIITTNDDNCNGNNNNNNTRVSCNSQTLDHHQSKSPSSFSISAAVKSSTVRYRECLKNHAATVGGSVHDGCGEFMPSGEEGTIEALRCAACDCHRNFHRKEIDGVGSSDLIPHHRHHHHHHNQYGGGGGGGRRPPPQNMMLNPLMLPPPPNYQPIHHHKYGMSPPGGGGMVTPMSVAYGGGGGAESSSEDLNLYGQSSGEGAGAAAGQMAFSMSSSKKRFRTKFTTEQKERMMEFAEKLGWRMNKQDEEELKRFCGEIGVKRQVFKVWMHNNKNNAKTPPTPSTL

SEQ ID NO: 152 - protein, 477 aa, Camelina sativa
MGGLMRFGELEEQFSQLSDTTIEEKVPFLQMLQCIDPNFTTAEPFLQSFLQIQTLEPKSCHTHTLDATTIKRDPGQTDDPDKDPRTEDGGAATTTVLKEKRKRKRTRAPKNNDEVENQRMTHIAVERNRRRQMNEHLNSLRSLMPPSFLQRGDQASIVGGAIDFIKELEQLLQSLEAEKRNDGTNETPKTASSTSSSSRPCTTNSSIQTLEPKSCHTHTLDATTIKRDPGQTDDPDKDPRTEDGGAATTTVLKEKRKRKRTRAPKNNDEVENQRMTHIAVERNRRRQMNEHLNSLRSLMPPSFLQRGDQASIVGGAIDFIKELEQLLQSLEAEKRNDGTNETPKTASSTSSSSRPCTTNSSVSSVSTTSEGGFTARFGGGETAEVEATVIQNHVSLKVRCKRGKGQILRAIVSIEELKLTILHLTISSSFDFVVYSFNLKIEDGCKLGSADEIATAVHQIFEQINGEMMWSNLSRRT

SEQ ID NO: 153 - protein, 80 aa, Camelina sativa
MSELPERPEERECSTYLVTGNCNLGKNCKYHHPKNITPIEPGLALNDNGLPLRPNQAVCPDFSRFGLCKSGPTCKFDHST

SEQ ID NO: 154 - protein, 285 aa, Camelina sativa
LGSTFLSLSLSLYLYLSLSPYSFIFIFVSLLVLVRSTNKNPRKEKNQRRINWRIKLMGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQLEISLRGIRMKKELMLTQEIQELSQKRNLIHQENLGLSRKVQRIHQENVELYKKAYTASTNGFIHRELGVVTDDESHTQIRLQLSQPEHSEYETPPRANE

SEQ ID NO: 155 - protein, 252 aa, Camelina sativa
MGRAPCCEKMGMKRGPWTPEEDQILINYIHLYGHSNWRALPKHAGLLRCGKSCRLRWINYLRPDIKRGNFTPQEEETIINLHESLGNRWSAIAAKLPGRTDNEIKNVWHTHLKKRVNKKQNNGGDTKDINGINETTTHDEDKESMIVETTSPQQFSNSISTFDISNDNNNDIMSYEDISALVDESFWSDFVSVDNSNHKEKKIEEDWEGLLDRNIKINSYNNSELYDDDMEFWFELFTSNRRIEEFSDIPDC

SEQ ID NO: 156 - protein, 168 aa, Camelina sativa
MKSVIDRYNKSKIEQQQLLNPASEVKFWQREAAVLRQELHALQENHRQMMGEQLNGLSVNELNSLENQLEISLRGIRMKKELMLTQEIQELSQKRNLIHQENLDLSRKVQRIHQENVELYKKAYTASTNGFIHRELGAVTDDESHTQVRLQLSQPEHSDYETPPRANE

SEQ ID NO: 157 - protein, 190 aa, Camelina sativa
MSQQRMKLSPPPLANNEQSPTASAVKSCSGGGGRATSSTTRHPVYHGVRKRRWGKWVSEIREPRKKSRIWLGSFPVPEMAAKAYDVAAFCLKGRKAQLNFPDEIDDLPRPSTCTARDIQVAAAKAANAVKIIEMVDVDDVADADDFWEGIELPELMMTGGGWSPEPFVAGDDATWLVDGDLYQCQFMACL

SEQ ID NO: 158 - protein, 254 aa, Camelina sativa
MDNLIVFVDEDDNQQLNGEKPPPRACARCSSNNTKFCYFNNHRVSQPRYFCKNCHRYWTHGGALRNVPIGGGCRKAKQARKDKSPVSRMVSPDIQQITPDIQQVNHQPFSYVQESNEFVGSFGASSSSGAVATVGNHFGSLSDIRGSMVPYVPPPSQSFQPNHRLDFQDGSFEHDYYNVGSSTNPFINQSIGGGYVDNYNGYGMEQYKWNQSFNNTLTMNHDASTSGSRESGMTMMNNDNKNKIIYNSVIKHPF

SEQ ID NO: 159 - protein, 290 aa, Camelina sativa
MDYQASRICEMVEDEEQIDLPPGFRFHPTDEELITHYLKQKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYSIENLPQTAKNEWVICRVFQKRADGTKIPMSMLGSRVDNRIEPAGLPLLMDCSQQDSFPGSSTTHVTCFSDQETEDKSLVHESKDGSGSLFYSDPLFLQDNYSLMKILLDGQETQFPGRSFDGHNPSALDGAEELDCVWNF

SEQ ID NO: 160 - protein, 476 aa, Camelina sativa
  misc_feature (222)..(228): Xaa can be any naturally occurring amino acid
MHGDGGAYGSRYQERFQGSTWGQKKQFTAVESSGSGGQRGSQMLSGELEGQVPSFNLNRKGMGPVWPKPLYKVKQGSAVKQNAVAKRSQEEEDAVGRGSTSQAVTVAPEETLTGLVKEGEETGFMEENDDLLEEGEYPEGDDAVIPDTELGKEDDTLTEQGTDSQSDMTGDSQGKPPVLVLPDSVLGLVNNALADVKLVDPVQNNCSKEELDNTKKLTNYWXXXXXXXFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYSIENLPQTAKNEWVICRVFQKRADGTKIPMSMLDSRINNRIEPAGLPLLMDCSQQDSFPGSSSTHVTCFSDQETEDKSLVHESKDGSGSLFYSDPLFLQDNYSLMKMLLDGQETQYPGRSFDGHNPSGLAGAEELDCVWNF

SEQ ID NO: 161 - protein, 230 aa, Camelina sativa
MGRGKIVIRRIDNSTSRQVTFSKRRSGLLKKAKELSILCDAEVGVIIFSSTGKLYDYASNSSMKTIIERYNKVKEEQHQLLNHASEIKFWQREVASLQQQLQYLQECHRKLVGEELSGMNANDLQNLEDQLVTSLKGVRLKKDQLMTNEIRELNRKGQIIQKENQELQSMVDIMRMENIKLQKKVHGAIEGNSSLNPIINGTETCAPPQLQLIHIQPPKEKTIKLGLQLS

SEQ ID NO: 162 - protein, 207 aa, Camelina sativa
MSISPTMSRTGESSSGSSSDKTIKLFGFELISGNRSPEITTAESVSSSTNTTTTSLTVVKRLECQYCGKEFANSQALGGHQNAHKKERLKKKRLQLQARRASIGYYLTSHQQPITTAFQGQYQTPSYCAFSSMHVNNNQMGVYNEDWSTPMSSQISFGNKNTCQDLNEQSGEMGKMYGVRPNMIQFQRDLTSRSGSKRSIKSLDLHL

SEQ ID NO: 163 - protein, 290 aa, Camelina sativa
MDYQASRICEMVEDEEQIDLPPGFRFHPTDEELITHYLKQKVFNTFFSATAIGEVDLNKIEPWDLPWKAKMGEKEWYFFCVRDRKYPTGLRTNRETEAGYWKATGKDKEIFKGKSLVGMKKTLVFYKGRAPKGVKTNWVMHEYRLEGKYSIENLPQTAKNEWVICRVFQKRADGTKIPMSMLDSRINNRIEPAGLPLLMDCSQQDSFPGSSSTHVTCFSDQENEDKSLVHESKDGSGSLFYSDPLFLQDNYSLMKMLLDGQETQFPGRSFDGHNPSVLAGAEELDCVWNF

SEQ ID NO: 164 - protein, 247 aa, Camelina sativa
MEEGGSSHEADNSKKIGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRTKKNEMLVTEIEYMQKREMELQHDNMYLRAKIAEGARLNPDQQESNVIQGTTVYESGVSSHQSHHYNRNYIPVNLLEPNQQFSAQDQPPLQLV

SEQ ID NO: 165 - protein, 733 aa, Camelina sativa
MSEPNMVPVDNNGDNDNNENNDMNNTDGGLYNTNGGAGAGVEAGVGAEEIDSARTVSDSREEEMGSDQGPPRKRKKYNRHSQYQIHEMEAFFKECPHPDDKQRRDLGRQLGLAPVQIKFWFQNKRTQNKNHQERCENTELRSLNSKLRSENERFREAVHLALCPKCGGKTAIGEMSFEEHHLRIVNARLNEEINELPALAVRFSSKAVISYPAISPRPSNHPPTFEFGAGSSSGSGGNLSRGITGPADVDTPMIMELAIGAMEELLLMAQVGEPLWMGGVDGTSLALNLDEYARTFRKGLGPRLSGFSIEASRETALVAMNPTGVVEMLMQANLWSTMFVGMVGRAITHEKLLTDVAGNFNGALQIMSAEYQVLSPLVSTRESYFVRYCKQQGENLWAVVDVSIDHLFPNIHMKCRRRPSGCLIQEIPNGYSKVTWVEHVEVDDREAANQNIFKHFISSGQAFAANRWVATLERQCERIASITTTDFQAVDSPDHLVLTGHGKTSILKLAERVTRSFFVGLTSSMGTTFSGVGGDDIRVMTMKNINDPGRPPGVVFSAATSFWVPAPPKIVFDFLRDVEHRASWDVLCAGGVVHKISEIANGRDSRNCATLLRNEIPCEKKMMIIQETSTDPTASFVIYAPVDTASIEGVLSEGQDPDYVALLPSGFAILPDGMGDQPGGSLLTVSFQMLVEEVHSGKLSITSVATVENLIRTTVLRIKALFPFQIATPSLGK

SEQ ID NO: 166 - protein, 233 aa, Camelina sativa
MLIIKVLILIHSLRTNLKKERKGRREDMEVEKRIVVNGGMRLPIGYRFHPTEQELILHYLLPKAFASPLPSSIIPVFDLFYSHPLTFPGDQKEKQRYFFCKKKEVSSNEHRIKILSGDGYWKPIGKERPIIACGRAVGIRRTLAFYETNKSSSDCNKTRWSMTEYCLAGFASAKVFGEWAVYNVYERKGTKARKQRKSRDIGDEDLSCSIHFTVGSDHETGPPPPSPPTSADE

SEQ ID NO: 167 - protein, 93 aa, Camelina sativa
MSDKKLPERPGKPECGYYLITGNCNQEKKCKYHHPKNITPIEPGLALNDNGLPLRPNQAVCPHFSRFGLCKSGPACKFDHSTKPSSSSSSARK

SEQ ID NO: 168 - protein, 458 aa, Camelina sativa
MQSSFKTVPFNPDFYSQSSYFFRGDTCLEEFHQSVNGFHHDLSPIWLFHFSFADVTIASSANLHYTTFDTGMDCGGLRERLEVEDECLDTGQLVYQKGTRLVGGGGGGGGEVNGSLENWCDSVSAMADNSQHTDTSTDIDTDDKTQLNGVHQGVVLATNCSDQSKVKSSEQRTLRRLAQNREAARKSRLRKKAYVQQLENSRVRLAQLEEELKRVRQQGSVVESGVTANHTHLPAGNGAFSFELEYTRWKEEHQRLINDLRSGVNSQLGDNELRMLVDAVMSHYNEIFRLKGIGTKVDVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 169 - protein, 533 aa, Camelina sativa
MPLFELFRLTQAKLESAQDNNPSPPVDEVVELVWENGQISTQSQSNRSRNIPPPQAVHQPNSLRARDIGNGSKTTMVDEIPMSVPSLMTGLSQEDDFVPWLNHNQSLDGYCSDFLRDVSPVTVNEQESDMAVNQTVFPLFQRRNNGNESAPAASSSQYNGFQSHSLYGSDRARDPPSQQTNPDRVTQTQEPLIPNNKPSLVNFSHFLRPAALAKTNNNPQGTKEKSPQSPPNVFQTRVLGAKDTEDKVFNESVASATPMNNQKACLISEDSCRRDQESEKAVVCSSVGSGNSLDGPSESPSLSLKRKHSDVQDNDCHSEDAEEESGDGRKGAAPSRTGLGSKRSRSAEVHNLSERRRRDRINEKMRALQELIPNCNKVDKASMLDEAIEYLKSLQLQVQIMSMASGYYMPPVMFPPGMGHYPGAAAAMAMGMGMPYAMGLPDLSRGGGSSVNQGPQFQVSGMQQPVAMAIPRVSGSGFFAGSSTMEMNKSENGSARDLPGSKDQTRTNNNNSSNLKPIKRKQASSDQFCGSSS

SEQ ID NO: 170 - protein, 296 aa, Camelina sativa
MALVNDHPNETNYMSKQNSSSSEDLSSPGLDQPDTTYAGGGGGGSASSSSTMNSDHQQHQGIVFYPSGEEHHNSLMDFNGSSFLNFDHHESFPPPAISCGGSSGGSCFSFLEGNNMSYGFTNWNQNHMDIISPRSTETPQGQKDWLYSDSTVVTTGSRHESMSPKSAGNKRSHTGESTQPSKKPNNGGNGKAKPKPTSSPKDPQSLAAKNRRERISERLKILQELVPNGTKVDLVTMLEKAISYVKFLQVQVKVLATDEFWPAQGGKAPDISQVKDAIDAILSSSQRDRTSNLITN

SEQ ID NO: 171 - protein, 202 aa, Camelina sativa
MNGGAWMWNPNKIEESEEDDESWEVKAFEQDTKGNISGTTWPPRSYTCNFCRREFRSAQALGGHMNVHRRDRASSRAHQGPTGAAASRSGGGTLLNSCGPPLPATLIIQSTASNIEGLSHFYQLQNPSGIFGNSGDMVNLYGTTSFPSSNLPFSVLNSPGEVPPRLIEYSTGDDESMGSMKETTGASVDELDLELRLGQNPP

SEQ ID NO: 172 - protein, 222 aa, Camelina sativa
MDASIVSFSETFPNQDSLNQSLEQRTKDEEKDVHDSSQEHLNQELNLIDCIDTTSIVKGSTSTEQKLFSCNYCQRTFYSSQALGGHQNAHKRERTLAKRGQRLAASASAFGHPYGFSPLPFHGQYNNRSLGIQAHSMIHKVSSYKGFGGHYGQLNWSRIPFDQQPAIGKLPTTENFHHHHHQRMMMAPSLSNNIGRSSSNIGRILEGTPALEQWCGDGGLLK

SEQ ID NO: 173 - protein, 323 aa, Camelina sativa
MEDSSFMDLMIETDEYLIDDWESDFPIWGETNTKPGSESGTEPGFELVPERPAKQMKTTNNNINTISSSPSSSSSSSGSRTSQVISFGSPDTNKTNPVETSLNFSNQVSTDQRMRSERKDCVNNGGRREPHLLKEHVLAERKRRQKLNERLIALSALLPGLKKTDKATVLEDAIKHLKQLQERVKKLEEERVGTKKMDQSVILVKRSQVYLDDDSSSYSSTCSAASPLSSSSDEVSILKQTMPMIEARVSDRDLLIRVHCDNNKGCLIKILSSLEKFRLDVVNSFTLPFGQSTLVITILTKMDSKFSRPVEEVVKNITLALAE

SEQ ID NO: 174 - protein, 306 aa, Camelina sativa
MGMQETDPLTQLSLPPGFRFYPTDEELMVQYLCKKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRKNGSSKLDDWVLCRIYKKQSSAQKQVYDNVMNGGRELSNNGTSSTTSSSSHFEDVLDSFHHEIDNTNFQFSNQNQFSTLRPELTEEKTGFNGLVDTPSFDWGGFAGNVEHNSVPELGMSHVVPSLEYNCGYLKTEEEVESSLEFNNSVGFGYSGQVGGFGFM

SEQ ID NO: 175 - protein, 307 aa, Camelina sativa
MGMQETDPLTQLSLPPGFRFYPTDEELMVQYLCKKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRKNGSSKLDDWVLCRIYKKQSSAQKQVYDNVMNGGRELSNNGTSSTTSSSSHFEDVLDSFHHQIDNRNFQFSNQNQFSTLRPDLTEEKNGFNGLADTPSFDWGGGFAGNVEHNSVPELGTSHVVPSLEYNCGYLKTEEEVESSLGFNNSVGFGYSGQVGGFGFM

SEQ ID NO: 176 - protein, 319 aa, Camelina sativa
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYVGKAPKGTKTNWIMHEYRLFEPSRRNGSTKLDDWVLCRIYKKQTSAQKQVYNNLMTTGREYSNNGSSTSSSSHQYDDVLESLHEIDNRSLGFAAGSSSNALPHSHRPVLTNQKTGFHGLVREPSFDWANLVGQNSVPELGLSHNVASIRYGDGGTQQQQTEGIPRFNNSDVLAHHQGFSVDPVSGIGYSGQQNSGFGFI

SEQ ID NO: 177 - protein, 323 aa, Camelina sativa
MSISSETQVPLSLPIIDFSSPDLKPETPEWDLVRSQVRKALEEYGCFEALFDGASMELRKVKLLEASKEVFDLPLETKQSTKTNIHYEGYLTLPIVPSQEGMGFYGVDNPNVVNDLTHKLWPQGNTFVSKNVQSFAEKLIELSLKVRTMTLESFGLEKYMEEHLNSANKHFQILKYKGLSDDDTKSKIGFYPHIDRHFLTILSQNDDVDGLEIKTKDGKEWIKVKPSQAASFIVMAGASLHVLLNGGIFPPIHRVITTGKKDRYSAGLFTIPKEGVIINAPEEMVDDEHPRLYKPFDFWGFLKFSNLPNARKDISDLTTYCAL

SEQ ID NO: 178 - protein, 311 aa, Camelina sativa
MMANENVETKASPLMASVDHHHGLGSGSGHDHHQGLSASVPLLGVNSKKRRMPRQRRSSSSFKLLSFPPLMPLSSHVPTPRPARKIDPGKLRFLFQKELKNSDVSSLRRMILPKKAAEAHLPALECKEGIPLRMEDLDGRHVWTFKYRYWPNNNSRMYVLENTGDFVNAHGLQLGDFIMVYQNLDSNNYVIQARKASEEEGEEDVTMVEEDDVYTNLTKIENTVVNDLLIQDFNHQSSNSNNNKSSYYYPVIDDITTNTASFVYDTTALTSNDTPLDYLGGSTTTANNYYSDFGSFEGLGSVENISLDDFY

SEQ ID NO: 179 - protein, 352 aa, Camelina sativa
MLTISRFLGVQTMSAVFETETSIFHMYNHDLPQTQMQTFVQEPVEEAPVARQNSILSLTLDEIQMKSGKSFGAMNMDEFLANLWTTVEENDNNGGGGGGSVAHHGEKPAVLPRQGSLSLPVPLCKKTVDEVWLEIQNGVQQHHRSSTSRQNSDEDIRRQQTLGEITLEDFLVKAGVVQEPLKTTMRMSSADFDYNNPEFGVGLHCQNQNNYADNRSVYKENRPYYSVLGDSSSCMTGNGRISNNQYITGLDAFRIKKRIIDGPPEVLMERRQRRMIKNGESAARSRARRQAYTVELELEVHNLTEENTKLKETVEENEKKRRQEIINRSKHVTKEKSGDKLRKIRRMASAGW

SEQ ID NO: 180 - protein, 258 aa, Camelina sativa
MEDVKVEVREVKKIENEALETGLAERSMLLMKAPSLVARSLQSLPFPDDPYRPDAKVILYLDLVAHEDEETKFVMELARAESGNMPRRYTLDMSKDFVPMNVFCESSDGKMSVEGKIKNKFDMRPHNENIESYGRLCRERTNNYMGKNRQIQVIDNARGMHMRPMPGMIIPTAAPDKKKVTNRTSEMKRTRRDRREMEEVMFNLFERQSNWTLRQLIQETDQPEQFLKDLLRDLCIYNNKGSNQGTYELKPEYKKATQ

SEQ ID NO: 181 - protein, 78 aa, Camelina sativa
MAKTSSSFVLPIIFLVMFALVEQNMGCMAVLGSCGVITDCSGACKSKFGQDTLSRCDRDGGAGTCICSYPCLTEKPHI

SEQ ID NO: 182 - protein, 235 aa, Camelina sativa
MRISCNGCRVLRKGCNQDCTIRPCLQWIKSADSQANATLFLAKFYGRAGLLNLIESGPDHLRPAIFRSLLYEACGRIVNPVDGSVGLMWSGNWAQCQAAVDAVLNGLPITHTPLPSASASHQIIPPHRTYDIRHVAKDPTTGGDSSESLATRVNADKGKTQTGRLKRHAESVNQLGECSHDTWQLPSSGATHGYGHFTLETVESRREAPLDQSSSNLGFDDQVDINEVGLELRLG

SEQ ID NO: 183 - protein, 183 aa, Camelina sativa
MRSLKEIRCLSLAPNVVIIRYWPNNNSRMYVLENTGDFVNAHGLQLGDFIMVYQDLDSNKYVIQARKASEEEEEDVTMVEEDDVYTNLTKIENTVVNDLLIQDFNHQSSNSNNNNKSSYYYPVIDDITTNTASFVYDTTALTSNDTPLDYLGGSTTTTNNYYSDFGSFEGLGSVENISLDDFY

SEQ ID NO: 184 - protein, 338 aa, Camelina sativa
MSAVFETETSIFHMYPQTQMQTFVQEPVEEAPVARQNSILSLTLDEIQMKSGKSFGAMNMDEFLANLWTTVEENDNSGGGGGGGGSVAHHGEKPAVLPRQGSLSLPVPLCKKTVDEVWLEIQNGVQQHHRSSTSRQNSDEDIRRQQTLGEITLEDFLVKAGVVQEPLKTTMRMSSADFDYNNPEFGVGLHCQNQNNYADNRSVYKENRPYYSVLGDSSSCMTGNGRISNNQYITGLDAFRIKKRIIDGPPEVLMERRQRRMIKNRESAARSRARRQAYTVELELEVHNLTEENTKLKESVEENEKKRRQEIINRSKHVTKEKSGDKLRKIRRMASAGW

SEQ ID NO: 185 - protein, 330 aa, Camelina sativa
MEKTVDTHKNTSSNQTLHPNQNDCHWYEEIIDDDIKWSFALNSVLHQGTSEYQDIALLDTKRFGKVLVIDGKMQSAERDEFIYHECLIHPALLFHPNPETVFIMGGGEGSAAREILKHKTIEKVVMCDIDQEVVDFCKRFLTINTEAFCDKKLELVIKDAKVELEKREEKFDIIVGDLADPVEGGPCYQLYTKSFYQNIVKPKLSPNGIFVTQAGPAGIFTHKEVFTSIYNTLKQVFKYVKAYTAHVPSFADTWGWVMASDQEFEFEVKEMDRKIEERVKGELLYLDASSFLSASTLNKTISLALEKETEVYSENNAKFIHGQGVAYRHT

SEQ ID NO: 186 - protein, 129 aa, Camelina sativa
MVVESSSHRNLCRLLMHGKKQATRTRFSLQKQVSIFNDGKTKNNLSFSLRRRSMPARLQVSCAAKQETVEKVSEIVKKQLSLTDDQKVEIVMGLEEEFGITMAEERAKEIATVQQAAELIEELVQEKTA

SEQ ID NO: 187 - protein, 310 aa, Camelina sativa
MMANENVETKASPLMASVDHHHRLGSGSGHDHHQGLSASVPLLGVNSKKRRMPRQRRSSSSFKLLSFPPLMPLSSHVPTPLPARIDPGKLRFLFQKELKNSDVSSLRRMILPKKAAEAHLPALECKEGIPLRMKDLDGRHVWTFKYRYWPNNNSRMYVLENTGDFVNAHGLQLGDFIMVYQNLDSNNYVIQARKASEEEGEEDVTMVEEDDVYTNLTKIENTVVNDLLIQDFNHQSSNSNNNKSSYYYPVIDDITTNTASFVYDTTALTSNDTPLDYLGGSTTTTNNYYSDFGSFEGLGSVENISLDDFY

SEQ ID NO: 188 - protein, 399 aa, Camelina sativa
MKINITIACMHIAYIYLHHCRLRLFFTLKVSVSTDTILNYLPFFFFFLLTTFFFQGVQTMSAVFETETSIFHMYNHDLPQTQMQTFVQEPVEEAPVARQNSILSLTLDEIQMKSGKSFGAMNMDEFLANLWTTVEENDNNGGGGGGSVAHHGEKPAVLPRQGSLSLPVPLCKKTVDEVWLEIQNGVQQHHRSSTSRQNSDEDIRRQQTLGEITLEDFLVKAGVVQEPLKTTMRMSSADFDYNNPEFGVGLHCQNQNNYADNRSVYKENRPYYSVLGDSSSCMTGNGRISNNQYITGLDAFRIKKRIIDGPPEVLMERRQRRMIKNRESAARSRARRQAYTVELELEVHNLTEENTKLKETVEENEKKRRQEIINRSKHVTKEKSGDKLRKIRRMASAGW

SEQ ID NO: 189 - protein, 187 aa, Camelina sativa
MPSSPPKAPFLRSSPKEAHEDQRFKCYKGVRKRAWGKWVSEIRVPKTGKRIWLGSYDAPEKAARAYDAALFCIKGEKGVFNFPTDKKPQLPEGYVRPLSKHDIQTISTNYAYSAVHVPSHVTTLTVTSQVPSEVYVSPNVSASTEITEVVDEYYLPTDATAESIFSVEDLQLDNFLMMDIDWINNLV

SEQ ID NO: 190 - protein, 339 aa, Camelina sativa
MNVEEEDGEPLSPMARVFQSPGNDCCILTMIGCKTKINANVLQHALKLNVSKHPRFSSRLSNDGACWIKTQVNVENNVFEPDIDPKEIGDNGEGYVEDYVSRLTMLPLDKSRPLWDMHILNIKTLDAEAVCVIRSHHSLGDGTSLMSLLVTCTQNTSHRDTIPTIPVLKRTVHKDIDVPWFVSFVLEGYKDASERISMMFYLELHKPLSRVMLNQLWIGKKHSLQAALAYSMTEYIFNIFGTKEGAIFLERIVSNTTTFISNMIGTKEEISFFGHPIAYIAPSVYGQAHALTIHFLSYAEKMAISLGDPTVIPNPQKLCDEMEDSLQAMKATISDRELL

SEQ ID NO: 191 - protein, 287 aa, Camelina sativa
MGNGMWKQEARDTTEEPPLINEKLEDERPQESTYIKPHVWNLRREDTDYYKQQRDDFALYGPNQHVDLFSRVGLHCYNLQKGTNLKILKVHKCDLWITSLITYFITFEAMDPIGNSSCEFETQVRYAVENIDCLSAITTRCKLKPKTPEEGDKYLEWNKDLVDNFFTGDMPEWMREDALTGRDKLQYYEMKDSELEENEWLHLYAELALFSKWQSKLNEMESAKPFEMKKIVVRTKENVESWKKVKAENAIFYISFKTRCGRDFNCIIRKTTDGKPGHFSLEVKCLM

SEQ ID NO: 192 - protein, 104 aa, Camelina sativa
MKFTAAVFIVFAIGAMMSPIPTRATVVEGSGKEVINAKCSAMGLSSCLPAMTSGHAPSTDCCTKLKEQKTCLCSYIKNPLCGSYVRSPNAHKTLEACGVPYTSF

SEQ ID NO: 193 - protein, 321 aa, Camelina sativa
MSFSGVGVLLDLYLTVGSLMLLELMVVMEAQPLVPSMFIFGDSVVDVGNNNDIYTIVKANFPPYGRDFTTHKPTGRFCNGKLATDFTAENLGFTSYPQAYLSKKAKGRNLLIGANFASAASGYYDGTAKLYSAISLPQQLEHYKDYISRIQEMAASNNNANATSIISDGIYINLYSLGARRIGVTTLPPMGCLPAAITVAGPHEGGCSEQLNNDAVSFNNKLNTTSQDLKRNLIGLNLVVFDIYQPLYDLATRPSEFGFAEARRACCGTGLLETSILCNPKSLGTCNNATEYVFWDGFHPTEAANKILADNLLLSGISLIS

SEQ ID NO: 194 - protein, 174 aa, Camelina sativa
MGATLMATTCVLLCAGLAAVLSSTYSIKKPLNDAVFLGAHGDFVISIKYLTILTIFIFSFFFHSLSIRFLNQVAILVNIPNLDPNLSGCLFLTSEHVSEMFEKGIFLNTVGNRLFYAGFSLMLWIFGPILVFLSVLGMVLVLYNLDFVSANDKKEKQRVVDCRRASDLLNDGDD

SEQ ID NO: 195 - protein, 292 aa, Camelina sativa
MGSLKELVAFIIIMCATSVTMTLAQNTMAPAPAPPSSDNPNTTVVLHNGGSVPMVFHCMSLDVDFKSRIMMPGGTWSFEFLPSVSGDTKYACSFTWRLEYHLFRIYWQSRDQVSGDHGCKRCEWRLRPEGPCQINEKTGKIDHCALKTPPPLLAITLTLSPPSLILSSASSSVRSLSLSLTIQSAMTLSFSQTSSFTRPNHVLGSTASVFSTPKNLRFCGLRREAFGFSPSNQLSLRSNRTQSSGFQVSASASSNGNGNGASPKSFDYDLIIIGAGVGGHGAALHAVEISYY

SEQ ID NO: 196 - protein, 726 aa, Camelina sativa
MKGLHVAANGGDLAEDCGILAGDADEAILMDGMDDVGREIWLDDHGGDHNHHHAHGDDDLIVHHDPSLFYGDLPTLPDFPCMSSSSSSSTSPAPVNAIVSSASSSSAASSSTSSAASWAILRSDGEDPAPNQNQYGSGKCDDTSGALQSTASMEIPLDTSQGFGCGEGGGDCIDMMETFGYMDLLDSNEFFDTSAIFSQDDDTQNPNLMDQTLERQQDQVVVPMLENNSGGDMQIMNSSLEQDDDLATVFLEWLKNNKETVSAEDLRKVKIKKATIESAARRLGGGKEAMKQLLKLILEWVQTNHLQRRRTTTITNNNLSYQQSFQQDPFQNPNPNNTNLIPPSDQTCFSPSTWVPTPQPQQTFVSDPGFGYMPAPNYPPPPPEYLPILESPPSWPPPPPQSGPMPHQQFPMPPNPQYNQFGEPTGFTGYNMNPYQYPYIPPGQMRDQRLLRLCSSATKEARKKRMARQRRFLSHHHRHNNNNNSTNQQNQNQVGETCAAVAPQLNPVATNATGGTWMYWPNVPSVPPQLPPPLETQLPTMDRAGSASAMPRQQVVPVPVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPTGQKQEAPPSSVAATKRQNKSQRNINNNSPSASVVVASPASQTVK

SEQ ID NO: 197 - protein, 533 aa, Camelina sativa
MKMYLKSDSDITSVDESSPKQPTYYVQSPSRDSEKSSSVALTTHQTTPTESPSHPSFASRVSNGGGGGFRWKGRRKYHGGRWSPADKEEGGDGRYDDLYEHNRGVSVVTCRFILGVVATLSIFVLLCSVLFGASQSFSPIVYIKGVNVHSFYYGEGSDSTGVPTKILNFKCSMEITIHNPSTFFGIHVSSSAISLIYSRQFTLAIAQLKSYYQPKQSNNTSRINLVGSKVSLYGAGAELVASDHNGGVPVKLEFEIRSRANIVGHLREEKMMDATSESERTSLDLSISSPKQAYYVESPSSVSHLDDGDKSSSSASLIQVHTPNYTILTESRLSSSSRTSNGTSGMGSRWKGSSRRSNMYWPEKPYTIHEDEVYEENRGLSVPQCRAVLVVLGTVVVFSVFCSVLWGASHPFSPVVSVKSFSLHSFYYGEGIDRTGVATRILSFNSSVKVTIHSPAPYFGIHVSSSTFKLTFSSFTLATGQLKSYYQPRKSKHIAIVKLTGAEVPLYGAGLHLAASDKKGKVPVKLEFDIRSQ

SEQ ID NO: 198 - protein, 730 aa, Camelina sativa
MKSLHVAANGGDLAEDCGILAGDADEAILMDGMDDVGREIWLNDHGGDHSHHHAHGDDDLIVHHDPSLFYGDLPTLPDFPCMSSSSSSSTSPAPVNAIVSSASSSSAASSSTSSAASWAILRSDGEDPAPNQNQYGSGKCDESSGALQSTASMEIPLETSQGFGCGEGGGDCIDMMETFGYMDLLDSNEFFDTSAIFSQDDDTQNPNLMDQTLERQQDQVVVPMLENNSGGDMQMMNSSLEQDDDLATVFLEWLKNNKETVSAEDLRKVKIKKATIESAARRLGGGKEAMKQLLKLILEWVQTNHLQRRRTVTTTNNNNLSYQQSFQQDPFQNANPNNNNLIPPSDQTCFSPSTWVPTPQPQQAFVSDPGFGYMPAPSYPPPPPEYLPILESPPSWPPPPPQSGPMPHQQFPMPPNPQYNQFGEPTGFTGYNMNPYQYPYIPPGQMRDQRLLRLCSSATKEARKKRMARQRRFLSHHHRHNNNNNNSTNQQNQNQVGETCTAVAPQLNPVATTATGGTWMYWPNVPSVPPQLPPPMETQLPTMDRAGSASAMPRQQVVPVPVPVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPTGQKQEAPPSSAAATKRQNKSQRNVNNNSPSASVVVASPASQTVK

SEQ ID NO: 199 - protein, 521 aa, Camelina sativa
MVHALSTPYTSSCISCSGPIVSTEENELWLENALLRSEIDTLTCFIRKLNSFINLYPVVGVSLTKWHYAVVAMTSLSLKEVVSLARQGNPMWACNDRLNLEEYYSNFFPWYARNAPGFVHEASRAYAMVPFDASLLVENLTNHVSWQKIFPSIIADVSLESHNRVFQMINVNFMQQISPLIQTRNVKLLRRSMRIENNTWVIVDISMYFSSYARHSRPNFMRFPSGYLVEHIANGISKVTVLDHWVYQEEEEVLINNFSSNSRFGAHRWLTALQRHCYNTWSISISSIGHQIQISGPICHTNLLNLSTWMVFIFCTGVCGTTRQKWKRLDTIGFSVNNIRMFTRESRDMSGIPWGFVSATGMARMQVTQEILFRLINRAKKQDIWENLASVKDMKELIRIKRCPNPGNEVSVFCIECNGPKEWYLIQETYYEAFGAMIICACIEAPCFTAIINGEDLSGVEILPFGFTIIPNGLRESFLSVACQVKINQTVLTDSDKLVEFMRNTIDDTLENVQNIRSVNP

SEQ ID NO: 200 - protein, 619 aa, Camelina sativa
MESLILLINEIQRACTALGDYGGGNNALTSLWEALPTVAVVGGQSSGKSSVLESIVGRDFLPRGSGIVTRRPLVLQLHKTDNGTEEYAEFLHLNNKKFTNFALVRKEIEDETDRITGKSKQISPVPIHLSIFSPNVVNLTLIDLPGLTKVAVDGQPESIVEDIESMVRSYVSKANMFCSQPTCLILAISPANQDIATSDAMKLAKEVDPTGERTFGVLTKLDLMDKGTNALNVIEGRSYRLQYPWVGIVNRSQEDINKNVDMMVARRKEREYFETSPDYGHLAARMGSEFLAKLLSKLLESVIRSRIPSILSSINKNIEELERELDQLGRPVAIDVGAQLYTILGMCRAFEKIFKEHLDGGRPGGARIYGIFDYNLPGAIKQLPLDRHLSLQSVKRIVSESDGYQPHLIAPELGYRRLIEGSLDHFRGPAEASVNAVHFILKGLVRKAIAETEELKRFPSLQIEIVAAANSSLEKFREESLKSVLRLVDMESSYLTVDFFRKLHVENQAVSISSPTTTINQYGEGHFRKIASNVAAYIKMVAKTLVNTIPKAVVHCQVRQAKLSLLNYFYAQISQSPGKRLGQLLDENPALMERRMQCAKRLELYKKAKDEIDAAVWVR

SEQ ID NO: 201 - protein, 212 aa, Camelina sativa
MLEKFGAVGDANVFYWFQNRRSRSRRRQRQLQAATAAPATSGGAADHQHMTAMTMHQYPYRNSEIDLGFGSCSNSSSANYFLNGTSSSSQVSSFLLGLSSSSGGCETNGMENFFTMFGHESDHHHQHSSNAHSMFCPSDENSNFQYQQGLMTVFINGVPTEVTKGRIDMKATFGEDSVLLHSSGLPLPTDEFGFLMHSLQHGQAYFLVPRQT

SEQ ID NO: 202 - protein, 255 aa, Camelina sativa
MGRGKIEIKRIENANSRQVTFSKRRAGLLKKAHELSVLCDAEVAVIVFSKSGKLFEFSSSGMKKTLSRYGNYQSSSDSKAEEEDCKEVDLLKDEISKLQKKHLQLQGKGLNILSFKELQNLEQQLYHALISVRERKERLLAIQLEESRLKRAELENETLRRQVQELRSFLPSFTHYVPSYIKCFAIDPKNAVLNHGFFDDSNCSLQKTNSDTTLQLGLPGEAHNRRKKEGDRESPSSDSVTTNTTRGTADRISLA

SEQ ID NO: 203 - protein, 172 aa, Camelina sativa
MENNNQPPPSYSQPPQTESSNPQIRDYWIEQMENVTDFKNRQLPLARIKKIMKADPDVHMVSADAPVLFAKACEMFIVDLTNRSWRHAEENKRHTLQKSDISAAVAGTYTYDFLLDVVPKDADPGFGPMPHPDGVPQYYYPPGIYPSPPTQAWPGEAGEGEAEGSGRNGGGN

SEQ ID NO: 204 - protein, 248 aa, Camelina sativa
MKKMLKSVSPMAFYDIGDQQYSALGYILSKPGNVGAYDIDPPMPTIDDAIYGSDEFRMYAYKIKRCPRTRSHDWTECPYAHRGEKATRRDPRRHTYCAVACPAFRNGACHRGDSCEFAHGVFEYWLHPARYRTRACNAGNLCQRKVCFFAHAPEQLRQSEGKHRCRYAYRPVRARGGNSNGVAMRLDGEDYDTSRSPEKSGKSGLDGNEEKVLLKCWSRMSIVDDHYELSDLDFDLNFGLDWISELVD

SEQ ID NO: 205 - protein, 218 aa, Camelina sativa
MLKSVSPMAFYDIGDQQYSALGYIVSKPGNVGAYDIVDPPIPTIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRARGGNSNGVAMRMDGEDYDTSRSPEKSGKSGLDSNEEKVLESDEHCG

SEQ ID NO: 206 - DNA, 770 bp, Cauliflower mosaic virus
agagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcg

SEQ ID NO: 207 - DNA, 462 bp, Glycine max
gcaacagaagacccaaaactcaaaaaagttagtttcgggccaacatttcctcttgagggatgacacgtgacctgctactctggcccttatctggcatgtccatccttcttggcgcgacatttaattcgtcgtcagaaataactgaaggacaccttgcttgtttctcttttggccgccaccggtcttgtcatcgtcgaaggcgcccttgcgcttgtcggcagaacctttttcggcgacctccttgccttttcctttggccttgttcgtcatttctacagagaatgcaatgagaccaacgccaattgcatggttagagttagagaaatggagagaggaagaagtgcgtgactagagtgtgtgtaactgtgaagaacgacgagtccaaaatgaattttactgtaaataatttgaggaaaaaagtgatcaatacatatcatgcggtgcatacaagaatcggccatt

SEQ ID NO: 208 - DNA, 1378 bp, Glycine max
ctagaaattaaatgtttttaacaggtaatttgagaaaaatgtacttcaaaataattagttttaccagtttatgtcttctttttctcttttttatctttattctatgtttcaaattctaataatacatcatttaaatatttttaatttaaaagtgcttactaaattttaaaaaaatcatatttatcaaataacttctactttaaatttaaacttcattatttttaacttaaaaataacttttaaattaaaaaaatgaaaacaaacactacctaaaccctaaacactatctatctaagtcacattacttaatgattcttaatttatgttctttgtaaactttcatttcttcctccttttggctatacatgttcatttctgtgtactttactatattattagtaaaagccttttatataggtatatcaaatcaaataattaatataatatataattctcttaatttcatttcttcatataaatgtatttcaaaagtatttcttctagaataaactaaagctattacagatgaaaaattcttaaaaaattatttgaccttcatatatgggtccttttctaattaataattaactatataggtgcattctaaatgctcctatattatctgctttctcctcttctttccttttttcctagtcgctcacgaaaatctcctataatcctctgcagttttcgaaatcaataaccgactcctagaacctgtccatgtctaacttaataaatcgtgagggtgtgattgtgattactttgaatctttaatttttgacattaaaacaagaccaaacaaaaaccttcaggttacgtgagactccaacctacccaagttatgtattagtttttcctggtccagaagaaaagagccatgcattagtttattacaactaactatatttcaatttcatgtaagtgtgccccctcattaaaatcgacctgtgtaaccatcaacctgtagttcgctcttttcaccatttgtctctctgtctttatcttccctcccccattgccaatatttgttgcaatacaacatctctccgttgcaatcactcatttcaaattttgtggttctcatttgccctagtacaacattagatgtggacccaaaaatatctcacattgaaagcatatcagtcacacaattcaatcaattttttccacatcacctcctaaattgaataacatgagaaaaaaatagctaagtgcacatacatatctactggaatcccatagtcctacgtggaagacccacattggccacaaaaccatacgaagaatctaacccatttagtggattatgggggtgccaagtgtaccaaacaaaatctcaaacccccaatgagattgtagcaatagatagcccaag

SEQ ID NO: 209 - DNA, 1500 bp, Glycine max
gatcctcacaaacctcacttggagacataggtgtgagggtaacctttttccctttatgtacaaatgaaaatttgtttgtgacaccattatggacaacatccttacactactaaaaaagcttttttttacgacatcatatttacgacagtcatacaaaaacgtcttagtatgtataaggatggcaatttcgtaaatatttcaaacatttcaaaggcagtttcagaaaaccgtctttgaatgcggccattttaatttttaacgcgcccctcgcatccgttcctcttctttccgcaaatgtggtgctcgttccttttctttcccagctggcatctgttcctctccccactcgctagctatcttctgcttctcctcttctctcctcttcccattacatttctccaccttctccctggtaccaccaccgccccccactccacattcgtcctccgcccccattcccctatcctccagtaaaattacaaaaaaccctaacaccaaaaaaacccaaacccctgtcgcaatgaaatctccacccccaaatagctctttggaatagaatcaaggaacttaccaaatccattatatgctattggggttttggcatgtttccggtgtgaaagaaggaaaaagaaatgcgtatgcgatggtgatgtacgtaggtacgccgaaggactacgaattctacatagccatactcgtgcttctcaaatcgctggctacgctcgacgttgaaattgatcttgctgtgattgcttcccttgatgttcctcctcgatggattcgagctctgtaagtctcactccttcaccatcatttgccactttatttttatgtacttttactttattattatttgtaacctgtatttttatttggtttcggatatctgttgctttattattcaccctggaatttggttgattttattatttttgaaaaataaggaaagagatttatttgttagcttaattgttttaattggcgaatatgtttttcttttcccttttttgcacagagtgaagctttgttcttagggtaatggattcccttttttgtgatgctagtggatgatttgactgattagtgtttagtggaatgaagaaccagaactagtagtaggtagagggaatcacttttggttttggatgtaaacttagaaatgtgcagcactgcacagaattgatatttgatcgtgggtcaaattgtcaaaatgtgcaaagaatacaaaggcacaggtgatatcattccattttacgttttttaacgaagctgttagtttcaattcaattatttacatatataataaatatattgatacttgctttagtttcatgaattaaaagaatttgattttgtaaatttcatttgaatttgtttttgtacaagctctcaacttttattatatgaacgagaagtttcttttttcctttttgagtttatttgaacttgtggtgttctaattgtatatatttttgtgcaggtgtcaatcggtactactac

SEQ ID NO: 210 - DNA, 1261 bp, Glycine max
atctctcgacagttgcgaactgaacgctgagttggtaatgctatgccctatcgctttttgcaccgtcccatgatcatttcccccacaccaccccatcaacctctaaaaagttaagagtgaaaattacacacacccgaggagaagaaaagctgcttcttctaagcatcacaacctagttactttacttgtagggccttttccatttcccctaaattacccctcttttcatcatatgataataatatccagctcagactatagtatgatattatgatgtcagcataataggttggcactaaagtcttaaagggcattgtacatgttgcacctggcattcaaattcataaatactaacactgtgaaatagattataaatcctcaaataaatgtcacacggttggggttcgaatccactcaaaaaggctaatgggatgggatttaagtgccaaggaatataccatggactttaacagcaacacaatttacaatctaaaatgtattacttttttttttcaaaaaagatatacaaaataaggtaccaagaataaaaggagtatttagaaacagtggcaccaatttaataaattatttatataaaatgacacttatttaatttatcaatgataaaagtaatattgatttattctctgattaactgttcaattaatagtgttattatcataatctgtcgcaaaagttatttttatcaacaacaataattgatacaagtagtataaaattaagcctcttagttaatatagactacttgatactaaaaccatgttacaccaaaaagtaatttttatgtcacttgtctatataataattacgactaaattaataatttttaaaaatattactgaatccattaaccgaacttttataatgaaagtatttttatgctttaaaatcacaaacattgaataaactaaaaatgataccacggaattggaacaagagacgttccacacaaaagaaaaaaatatgttgaataattgaaacggtgacaagaaaagtggaataataatacaaagatggcagatggggttattgttattggaggagatgagtgaaataatgagtgaggggggtgtaactggaaagcaagaaaaagcgcaagagtgccagctatttccaacaacaaacgtggcccgtgggatgcgatattcgtaacgaacggcgaggatggaaggacgtgcaatttgcgcttcatttgaggcgaatttcatttggccagaccttccttttttaaaccacaggg

SEQ ID NO: 211 - DNA, 1094 bp, Glycine max
tgtgtcaatgttgtttctggtgaattgacataatgaattctacctgtacggagtagagaataactatttacccaacaagaatgattatctcattaatttttgaagtagacgcaataacgaatatattatacattcagaaaaatttcaccatattattctcaaatcacaacaataatttgttttttttttgcttgatataaaaccaatactctatactttttaaggttaatttaaacttaaagagtatttttaagatgcatgtactttaaggaataatagaaacatgacaacatcataaaagaatgaagaaactgaatcataacgtagtttgttacgccttccatttggtggttgatttggatacaatctagattggtttgctaaatggtttataagttatgtagacgtttttattactactattttagacaaatcaaatacacaccttcactttattctattcaaataacatgatttttcctaacattttttaaaaaaattactttttaaatataaactaattattttagaaatagttttataaaaatccacgccaaaaaaattaagttgtttttataaatataaacatcgggcttcaatcttaaatttataaatgtacgaaataatttgacagttaaatggaaattgctagcatggaagtgtttttatcatttatcaaactcaaccaaactgaacatcagaataattattagtgacaaattttgcagcatatgaagtggcttgcatagctccaaggctggcgatcatatgtcagattagagcaggctctctttggtactatgatacatttcaagcaaataacaaccgtaaaaattcacgccaaaatttttggaacgaatctatatattattattttatttcttttgatttcatgtacgtacagtgcccgtaattgacatgtctttgttccttaatgcctttcccacgtggaacaggcacctagaaacttggactaagtagggaattgagggccatggactatagtgccaaaccaacatcattttatatatatatatatatatatatatatatatgctattgttttctatagtttttggaaattaatacttatc

SEQ ID NO: 212 - DNA, 1449 bp, Glycine max
atttgtactaaaaaaaaatatgtagattaaattaaactccaattttaattggagaacaatacaaacaacacttaaaacctgtaattaatttttcttctttttaaaagtggttcaacaacacaagcttcaagttttaaaaggaaaaatgtcagccaaaaactttaaataaaatggtaacaaggaaattattcaaaaattacaaacctcgtcaaaataggaaagaaaaaaagtttagggatttagaaaaaacatcaatctagttccaccttattttatagagagaagaaactaatatataagaactaaaaaacagaagaatagaaaaaaaaagtattgacaggaaagaaaaagtagctgtatgcttataagtactttgaggatttgaattctctcttataaaacacaaacacaatttttagattttatttaaataatcatcaatccgattataattatttatatatttttctattttcaaagaagtaaatcatgagcttttccaactcaacatctattttttttctctcaacctttttcacatcttaagtagtctcaccctttatatatataacttatttcttaccttttacattatgtaacttttatcaccaaaaccaacaactttaaaattttattaaatagactccacaagtaacttgacactcttacattcatcgacattaacttttatctgttttataaatattattgtgatataatttaatcaaaataaccacaaactttcataaaaggttcttattaagcatggcatttaataagcaaaaacaactcaatcactttcatataggaggtagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttc

SEQ ID NO: 213 - DNA, 1321 bp, Glycine max
aaaaacacaaaaaaaaattatacaaaaatgtttctcacaacatgagaagtaaaatccctcaaagaatttcacatcatcatatcagaatcaaaggaatcaaaatcataggtcaaaaatacaaaaacaccaagaacactcaatttattaactaatttgcatcatgacatcaattggtccatcaaacacaacaatcttgtaattataatcgtaacgaaagaattacaatgcaataaacatcccaaaataaacctcaatttaatcctctaaggatccctatacatgttcattctaaccccaattgtgataaattcatcccttacctctaagcaggctcacgtgtgtagtctggcagtgatagaggcatctctagtggttttctaatagtcctcaagcttgtttttcctctagttgttctgttaggattttcaagcgttagagagaagaagaagagattggagcctctatttcactgttaccgtacaagggatatttttctcaccataaacattattttgcaaatcccaacgaaggagatgtccgtacataagttcgaaacctggtgctcgaatttcacgacgattcaatggttaacaagtccaagattgtatttttactgtgacagatttgagtgtatacaagaaaaagagagctccatgcgaggaatatttctctcacagtagacattatttcataaatcccaatggtaaaaatatgcaaaaatgagtttcaaacctgcttttaaaatttcatgacgactcaacggttaacgtgtccgggattatattttcactggaacaagtttgagtgcatgcgggaaaagagagggttttgggagaggaaaaaaggaaaacaaatttaagaggaagagagagcgtaaaaatttatcgtaaatgtaaaaaatgacctaatatatctctatttataactagggtactctcaatctattatttactcatttttttattttattattttataaaaaagaattttattttacttcctatcaaattaataaataaaacattcttcttattttctaagatcacatatttattttatttaccttaaaatcatcattttaattaataaaattatttcttcttatttatttaattacaaaaatcttattatttttttaaaattttatttatttttaaataaaatattttttaatttattttataaaaaatgagatgttacattgaattataaaataaatagccaacaataaatagccgacttgcttttgcattgactaaggaagtcaagtcatcaataaatataatttccagttggcaatattctcaaagttggtctatat

SEQ ID NO: 214 - DNA, 514 bp, Glycine max
agatttgatcgatacttcattaaattgacattttattttaacacataatacattattaaaaatataaataaacatttacagcgaagttatataattaaaagcctggtctatgtaatggtaggaaatttgaaaatctaaaagcaaacaaaaattgttgtttatggtgctaagttgcacctggaaagatgcattgtttagctaaaacattcacgtcgagtacttggtttgggaaaaaaagccattcaagcttagctggtcctctctcctgtctctctctctctgtctgtctctctctgtctgtctctctctcaagcacatacacaaacaaagtaagggctataaataggagggatggaagtggaagaaagtctatagcgaagtttcatttctttggattagaaatttttcccaaagctgatcgagaagccagccaggccaggtctgtagttttctttttttctttttaatattaattcattattgtgttcttcatcatataatataattaagcctt

SEQ ID NO: 215 - DNA, 702 bp, Glycine max
cgcgccgtacgtaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgc

SEQ ID NO: 216 - DNA, 579 bp, Glycine max
acgcgccgtacgtagtgtttatctttgttgcttttctgaacaatttatttactatgtaaatatattatcaatgtttaatctattttaatttgcacatgaattttcattttatttttactttacaaaacaaataaatatatatgcaaaaaaatttacaaacgatgcacgggttacaaactaatttcattaaatgctaatgcagattttgtgaagtaaaactccaattatgatgaaaaataccaccaacaccacctgcgaaactgtatcccaactgtccttaataaaaatgttaaaaagtatattattctcatttgtctgtcataatttatgtaccccactttaatttttctgatgtactaaaccgagggcaaactgaaacctgttcctcatgcaaagcccctactcaccatgtatcatgtacgtgtcatcacccaacaactccacttttgctatataacaacacccccgtcacactctccctctctaacacacaccccactaacaattccttcacttgcagcactgttgcatcatcatcttcattgcaaaaccctaaacttcaccttcaaccgcggccgc

SEQ ID NO: 217 - DNA, 1500 bp, Oryza sativa
gcagctgttttcgcggtacagggtgcaacaaaagcccatgacggcccacacctgcctctctccgctccaaacaccgaaacaagggggtgggtgcaatgggccggcgctcgaagaccgcgaactctttccaacagcccagcgcattagcccctcctcctactctctctaccttctttttaacatgcgactttctttctgtggacgacggcatcaacgacgggagcaggagcgggggctgaagcacggtgcgtgggctcctggagtggcgacggcctctccggcgagcttcctctggcgaactccctccgctcctcctatggcgaaatccaaacaagggtcagtttcgactccaaccttctcccaccaccacctcctgaccgtgccaccacccggccttgtcggcactgaaaggcgtcaacttgtcagcgcgggcctgctcggtcggtctcctcctcccctatttcgtttagctttgcccccgccaccaacaccggcccacggcccatggccgaccccgcggctttggcgccgccatcgctatctcgccgctgtccttttttcatgaccttcggtgccatccctctaaattcgatgcacctccctggctctatctccctttacctccgaaatcctaaccctacccataatctctagtgagtcttgtctttatttatggcctctttgaatcgcaggattgataaaacgtaggattttgataggaatgtaagtgtaaaacacatgattgtaaaatagaggaaaaacataggaatggccgtttgattgaaccgcagaaaaaacacaggaattagatgagagagatagactcaaagttactaagagattgaagcttttgctaaatttcctccaaaatctctataggattggccattccatagaaatttcaaaagatttaataggattcaatcctttgtttcaaaaaacttcatagaaaatttttctatagaattaaaatcctctaaaattcctatgttttttctccaattcaaaggggcccttaggttggaatttggaaagtgttcgcgagaaatcaagcggtcgcacgttagcgaattaggatttccggaaacaaaggaccgactccgcctatccatcgtcacgagcacagtgtagaacctcccagacctcaagagaccgttcaaaaagcgcgcgcccaagcggggcccaccaacgcgtccccaccgtgtcgcctcctgattggttgtcccctcttcctttcacgcgaaccggcaccctcccgacccttccagaacccccaatccgacggccaggatcgcccgcgcgcgaacgttctagacccccgccacctccgccacaaaacctctgcccctcccctctccccccgcttcgtctcgttcgagaaatcagaaagagagagaaattcccacgcagcagcaagcaatccaatccgagagcgcgcgtttgcgattattcgctttcgattccgcgaggtttttggagagggaggagaaggaggaggag

SEQ ID NO: 218 - DNA, 1500 bp, Oryza sativa
acagcatttattgtagtctggtcaagcgtgtcacgctgcatgcaacgcagtacagcgcgttcctttacccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggttagatttataccaggcttcatcctaaccattacaggcaaggtgttacacgaagaagggcaaaacatgcacgttgttaaactgacgcgtgggggacaagaatgaccggtctgacactggtcgcatcagcaacgggcagccacgatcccgcgtcatctccgtctccgccgggagtggaggtaggtgtgggctgtcccatcagaagggctcccggatggaaaccgtaccgatctccgcccattaaagagaaaaagaacagtccagtttggaaagagaagggtgcatgtggtatccccttgaagtataaaaggaggaccttgcccatagagaagggggttgattctttccagattcagagcctagaacgagggagaggtgggctcacactttgtaacttgtccatacacaaatccacaaaaacacaggagtagggtattacgcttccgagcggcccgaacctgtatagatcgtccgtgtctcgcgtttcttgctggctgacgatccttccacatacagagagagagagagcttgggatctcaccctaagcccccggccgaaccggcaaaggggggcctgcgcggtctcccggtgaggagcctcgagctccgtcagacatgttcagtttcattatattatgaaatgtcacgtactgtttgttctagttagtgaattgtcatatggtaagaatatataaaaattaggttttctggactctatcttccaatgtatttttggatcctataacaaaatattttcataaatatattttttaagaatctaaacttttttgaaataaaagagcaacaaagaaaataaaaacgctctctcgtaagtaactcgtgaagatccatcgagagccactcgtttgaatcgtcgacacaaaagaacacttcattgattgcttttcgtcaattagccgcacagcacagtactctccaatctgctaaaccaaaaccaatctcatccatccatacccttcttgacaccaagtggcaactcctgattggacgcgccctatcctacatggcacccccaagattctctcgataggctacaggggccacaccgaccctccacgtcatcgtccacgtcaccctcatcccggcccatccagccaatcccagcccagcaaaaaatcttcccaagtggccaccagataagcctctccacgtattaatacgccaagtgttcgtcgccatgacacagcacgcacacacaccccaccagcagcagcagcagtagctgagcttgaagcagcagagcgaggtagac

SEQ ID NO: 219 - DNA, 1500 bp, Oryza sativa
tccacctctgttggttgcatcgacgtcgcttccctagctcccgtctctagtccggatcctattcctccttggagaccgaagctaccgcaaccattgctcggtggttagcgagcgtggagctgtcctccccactttcgcgtcctcgttcgccaccacagccatacttcgcatggtgatgtcttctccttcactcaccgctaaactcagtgcaaccgtttctaccctagccccggccgccgctctcatagaggtgaaagttcatttacatgtaggtcccacatgttttatgttttttatttttcttttactgattagcatgccacgtaaatcaaaacaacaatccatagtgttttaagtatttttatttaatacgtgagatggagtacaaaaacgagagatgcaaagtgaacttgctaaaacacattttctggttgattacagtcgcttgttgagccattggatcggtcataggattcgtgctagcatacttaattacgcgtaactagttgtgctttataggttacaggtcgctaattagcggtctactggagaactttgctactatttttttcttcactgcatgcactcgatcaagtatgagtatttgtaccgaccagcgaaacacatatgtaattaaagtataaatatgtaattagtatatattagtagtatatttagacagtagttacaccctacatacacaccacttacatatataattagtatgtaattttgtaacttacatatgtaattttagtacttacatatgtaattttgagacttacattgtaaatacactaaaattacatatgtaatttagtaacctacaatgtaaatacatgccgactaacttttgatgaaaaatatggtgttataaatatagctactcccgaactttattccttctctgtgagatatcagtggaaacgctcggtggaatcgggggagtatttgggagcacgcgccgacgcgcgcgtcgtgcgtgccgtcgtctttgtcgcggtggagcggagcgcgcccacttgcgcgcctgggccggaggcgggcgcgccgggggttcgggaatcccctggagccacacgtaaaggcgcgggcgggagggagggaggggccagctaggataaggcacgcgcggccgctgcgattggggcgcttgtgaacaccggggcgccacgtggagaggacgttacactccagccgccaaatttccactcccacacccgcgctcccctcccctctcttttccgtgatcgcacctcgcccacgcgccccccgccacacacaatctctgcagctctccagcttcgttggaactcgcgaatctctctccgatcccaggtaaagcagcgaacgacgtcacgcacgacgctgctcggtggatttcgttccttgctggggaaaaccatgcagagacgaaggtgaatgatctgcttttgtgtacttgcgtttaccaggtgaagcgcgagcttggagttggaggggagatcgatcagggccagg

SEQ ID NO: 220 - DNA, 1500 bp, Oryza sativa
ataattaattaattaatcaatcacttttcgtgctgtaaaaaatctcacccgatttgctgaaacgaactgagccgggcgactgtgatattctttcacgatttctgtttgtggcagtgggacattgctgtttattcgaaacaattttcaagtaaaaaaaaatactcaatggtaaggttgctagtaatagtttaacagtttgtttgcagctcagcaaatttcgtttcctcacagatgacacataactgaaagcactcaatgtaatgttgtgcttagctgctaaagcatgtcacgtcttagaaaacaactactccaccatggagaatttttcctcctacttactcctcacatacttaccatctccatataagttcccttgtcgtatcatatgtcttattcttcttgagcacagttattacagcagattttgtagaatagttatcgcatcaaaattttcctatgtcacctttgatcatgtgttatgtgtgcctcttgagtcttagggttaatgtggttgtaatgtgtttaaaaaactatatgaaagctcgtgtgttgctacgggagagagatacctcgaatgaatgtgagagatctccatttgagttgtgtaccttgagagagtgaaagatcacactatttatagacggttaataatggttactgaggtcgattcaccacatcgtcttaaacatttaatgagcatcctccacgtgaaaagtagagatgatagcgtgtaagagtggttcggccgatatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcataag

SEQ ID NO: 221 - DNA, 1945 bp, Oryza sativa
aaggtttcatgcgtatcgtgacagatgttacataatgacaaattccccagctggagcacctttatccctgctgtttgcatgaaattagcttgtcttgtagttccctccagcaaaaagaagtctgaaacaaaacaacatttcgaaaaaaaggcatccatgagttagcatttctacagttgtctatagaggggaaggctgcacgacaaagtttccaggcttggaaacaacctcttatgtaaaatttttcgtatgtatcagatgatttgtttgcgttacggcatctccacctaacatcaccttcatcatgcgcctatggtctttctcttgcctgttttatacgtaaaattggaaacgacagaaacttttgccatctttattaaaggaaggcaaatatgcaaatataggcatcaagatcacagttagtggattatcatctttgtaggttaacatgtcctaccccaggggagcttatactcaagtactccatgcattttcatgaaatgagaaaaaacgatttttaagagaaatgtactttcttgtatttatgccaaatggcaaggactgaaagggaaaaactaagaaagggaacgttacagtaaggctctgtggggactggggacttcagagaaacgtgaaccctgcttccttcctctgcatgaacataacaccagaggtttccagcctttcacacagttgttgatggcttcacacaattcatctctacctcctgactctttataaggacccccagcatcaccacaattgcacaagtacaggcattagatccacaagaacacttgggcaggcaagcacctctttgatctttaagccgttgttatgttctatttctgagcatatggtttctagttatattctttttcttcattcgtttcatatctttgaagtgttgatgcaaatgcggtgaacaactatcaactgtgtactctccaagtgaatgcgaataatcatttcctgtgagaattgtgggctagataaacgaatgaaatgctgttttatctatgtcatgtgtggaaatttagttaattttccggtctttttatgcattgagatgggtatgctgtttttttagttgggtcccatcatcttgagaattctttcaaatttccttttctttatcctatataaaggatagagaaggcgtatgcctaggtgcaccaaccctgaaagttttattctaattgcgggaatggtttgtaatttttgcttgttcaggttctttttcgtggcctttcttttttttccccttattttgcttagtctttcacagtccaatttttgggaagtagtatatcttagtttggtcctaaggcaccatgttgtactgcaggaaaaaaaagagtaattgtattctgttttttccttgattactatatccctgttttaattaattttgtgcctttgttgtttgatgttggaacttcaatgcccataattagtcatttgacttgttttgggttttgacgctatcttgagtgccataggaaactggtagaatttagtaataattttatatagactgaatgttgagcccaccacaaatggtttccttctgtacaagtatttaataactcaagcacaggaaacatcagatctctaatctaaaggttaacaatgggctcaagcaggagcagtagttcagctctatctgtatatttagaagggctggatctacctgtccaccagcttttaattttaccctggcagctggataacttcttgtctgttaatttcatttagtgctgtgttattttcttcttgttgttcaggatggatgcttttgaatttctggaatttcgtattttgttctatctctttatgaaatgacgttatggcacactttttctgcatattcttgatgaaaataattacctagtcatttttttagttgcaggtttgtctgggactttgagtacccatgcaattc

SEQ ID NO: 222 - DNA, 2315 bp, Oryza sativa
gttcaagatttatttttggtatttaatttacttgcttaagtcagatatattcccatcgttgcaggtttgtcacttagtattattattaagcgctctagcactaggactctggataaataagaaagtttattcacgaggctagagtagtaatcaataacataagcgtggtgtctaggtcagcggttatcttcatatgtagtgtgctccatggaaagtgaggtaggaggaaggtggtgacagtcccgtccgtcctttgtatccctccatgttcgggtatatcatagagctacaggctagacttagcttggcagactaggggagagccggtgctcgaagcaatccatgaggctttacatttaacataagttagtaaattaacccataggaatcatctctagactgaacctaccagtagttgtgcttggatataattatattcctacatatacatacacgttccctgcgattagatacccttggaatactctaaggtgaagtgctacagcggtatccgtgcgcttgcggatttatctgtgaccgtatcaaataccaacaggtagatacaaggaatcatctctcctatccattggtttatcatcttttaaaattatctcttgctctcctattgcctctgcaactgcggataggtgtttctcaacaatgaaggttgtgaagaatgctttgtgcaacaagatggatgacaagtatctcagccatagcctcatttgctttgtagaaaaggatatgtcggacacaatcactaagtatcaccgtggaaaggatgcactgtatgccctatctatatttaccatttagtaatatttatatggcttgtgctaactttatgttgtctttacaggcaataacattatttggaaggcatatctatatattactatttaagataatgtaatatctcaaagtttttataagctgcaatgaggtgagtttcacttagctttctaacttgttatgagttatagatgcatgccaccagtcattttttatcttgcatcagcccctgcctgttagaatatgtttctttgtctgggagtccatgtcaactagccaatttccaaatatatgaacaaaactatgtggcctttgtaacccaaatgagataaagactactctccatagaaatttagcaaacatggcactcaaagaaaatgtgttggatagtttcatcatgcatacaaaagcaacacttttgaactaccattccaaatcctttttgtaaattatctttgcttaacactacccctttgagcaaatgtggctttgtgcggaaaaaactcaaacttggtagggtagacatccatttatataattggatccatgtacataagttgttgagtacttcaagtacttacccttgtgatatacatctcaaatatattgaagaagagaagttctttttttgagagaggttgaagaagagaagtttgtccatagctgaagaggagttttatagtgtctagcttaccttgctgctgattgcatgtctaaaatgtcgtttaatttgggctataatgaaatattcaccaatatttctgctggtctattaaagtttaatagttactcgtaactcatttattttgggctataatttaatattcacctatgtttttgttagtctattttatttccctagtgtgcactagcttaaccccaaattagttttgaacacttaacctaaatgtgtctattatggtcagacactctctcacggcactctaacaaaaagtgaattttgttgttatgtttttgtcatgatctcacaagcaatgtacatgtacgtttctagagtgcaatcttatgctagcctgattgtgaatttagtgtagtttgttttctctttttgtagctacactaccaataacctattgtcctctagtcataccacgtaatcacaaggcaaatccctaactctcacctttaaaagcatgtctttattttcttgggtggcactaatacaaaatctttttcagcattcctatgtgcgatagcaagaaaacatggcataactcttgcttcactctaacaaaaaaaacacttttccaactttaaaacaatggtatctatgtgtttaatgatcaatcaagcatataatgacttacaagtttttacctatgccctttttgcatcatcttgtttgcaacagacaaactagatattcctttaggctataaacacatcagcatgataaagagattaggtaagtttgttatccctttttgcatatattctcgtctactccgtgtatataagcccctctcctccaactcgtccatccatcaccaagagcagtggga

SEQ ID NO: 223 - DNA, 1194 bp, Oryza sativa
ttgcatgccgtcgtcttaagcgtccgcgtgtgaaaatcggattttcgcatacggttgaaccggtcgcatgcaaagatcgcgatcttcgcagacgatttggcacatgcggttgcaccaaccgtatgcgaaaacccttctcgcccgtatgcaaaaaccatctttgttgtagtgtacggttcacaatggtttggatgggaaatcattgtgaaccaaaagtgatagactgatttcgacgagtgtttttttttaagtagtgccacaattttggtcatcatacgtcgtgtctaaaattgtaacttttgaaaaccaatttacattaaattaaatttataagactaaataaagacgatggtcattgaacaattgttgagaaaaatctacacacatgtgtgtccaacacaaatgtttacacatatactactatgttcatagtcgaagttagattttttttttccttaaagggaaagtctgttttcaaattttagacctcactccttccgtttcaaatatatcgtgtatttttttttctagggcaagcttttgaccaatgattactctattatgacacaatgttaaagggatagattcatattcaaaattactattataattataattttgtcatataaataatattttaagcaattgttagccaaaatctcgtcctaacgaaacaaaatacgccttatttttaaaaacacggagtatatccttaaatatttctctatccaatataaaaggtcaatcttttaaaattccgatcatcaataatttctcaaataattactttgaaataaaaaaacatatgcaaatttgtgtcgtcataatatccaatgaacttattcaaatttataaacttattttaattcaaaatttgatcattaattttttttttaaaaaaaaaccaaatcttatcataaacgtcaaatatatttttgatagtgggggcgataataccataaaactaacaacagaagagacatgatactactactgtaatcctaatacgtacgtacgtatacttctacgccggatgcataacttcagccttgtgagacacaacagttgctgcctagctcgtggtcgttggttttttcgctcgagaaaccactacgcgtaaaccgtgaagtatattatatatagccaactggtcttctcgcaaatccgcacatccctttctgcccctcgtcttct

SEQ ID NO: 224 - DNA, 1500 bp, Oryza sativa
gcaaagaaggccagtggcctttgcagctaagctagctagctagcccttcttcctctctttcctgctttccctttgccttctcctattaatcctctgcacctcacacagcagcagaaaacccaccaactggagctctcctttcctactccaagaaacgaaggtagagaaagaaagatcagatcagcttcaggaccaattttagctaggttatatatctctttgcgtgctaatgtgttttagttatctgggtgtgtgtagagttctttgttaaggcactgattcagctgcagtttagattcaagtttgtatgttctctctttgaggaaaagaaacccttttcctgtgcttcgagttcttgcaaagagaaactgtgatgcttggcttccagtttgatgcttctttgttcagattggaaattcttcctagcttctttctctatttatgtagcaaggattctttccggcccagtgatcctggtttcttttggaaggtttcagttttttcgttctttcttgaaatttctcttcttgccttaggcagatctttgatcttgtgaggagacaggagaaaaggaagaagctagtttcctgcggccgacctcttgcttctcactttgtgatgagttttctttggtcaattcttagctagatatgttaagatagttagttaagcaaatcgaaattgctagcttttccatgctttcttaaacatgattcttcagatttggttggttcttttttttcctttttgtggagacgtgctgttcttgcatcttatccttcttgattcatctacccatctggttctttgagctttctttttcgcttcttcccttcattatttcgagcaatctctgcacatctgaaagttttgtttcttgagactacttttgctagatcttgtttactcgatcactctatacttgcatctaggctcctttctaaataggcgatgattgagctttgcttatgtcaaatgatgggatagatattgtcccagtctccaaatttgatccatatccgccaagtctttcatcatctttttctttcttttttatgagcaaaaatcatctttttctttcaaagttcagcttttttctcttgttttacccctctttagctatagctggtttcttattccttttggatttacatgtataaaacatgcttgaatttgttagatcgatcactttatacacatactatgtgaatcacgatctcagatctctcagtatagttgaattcattaatttcttagatcgatcagcgtgtgatgtagtactgtaaatcactactagatctttcatcagtctcttttctgcatctatcaatttctcatgcaagttttagttgtttctttaatccggtctctctctcttttttaatcagctgagagtttgtgctgttctttaatcattaccagatctttcatcagtactctctcttctgcatctatcaaacttctcatgcaatgtttttgctgttctttgatctgatctct

SEQ ID NO: 225 - DNA, 1500 bp, Zea mays
agttttcgcttgtctattcaccctctataggcaactttcaattatgtaatcactttttttttcttttttctgtttaaaatctcagtttcaaacttccaattgattttgaatacgaggtttgggtttaaattcatattggaggcaaaaatcgaaagttccacgtgatgctaggttttatttcggttttctatctcctattgtttttcacgtttcaacttgattcaaattctagttttttttaacttaagcacaattaaatacaacataaaaacaacatggattcaagttctatttcaatttttattaactattatgttgtctagtctgttcaagcacataatacttataaatataaaattaaacgaaatcacatatttccacaaatcttgggtactacactcggagacgacgatggattccatctcaatttggatgttgattatagctctatttcagttgtcactgttgtcctaacacgccctattgtgcatgatagtgcacgtgctcaacgtaaaagaaaagagatcagtaacaagtagcagcactgtacaaggtaagccgtgattcaattaaaactgtttgagcaattcagttgctagatcgttccaccatcgataattcgatatgtacgatgatataaaaagagcccataagtttgtcttgaaaaggttgatcaaataatttaaattagatgataaaaaacatggaagatgtgggagtggacgacggctatgaagaatagtactatatcaggtttatacgtaaaatttatttttgaaatgtttttataatctgtttgaattgtattttttgcttaattatgtgattggatgttttttcatgaaatgtcgagttttattttaaataaaattctgtaaagagaagttgctgcgctgagaaaactataaatcgatagtaaaggctgtacgcaacgtttaagtccttgtttgaatgcgtatgaatctgagaaagttcagaatgattaaatcttttttatttaattttaatttgagagagattaagttctctccaattctctttaatttagacgtaatcgaacaagctggttgccaaactagatgagtacattttgtccactgccatagagccatcgactacaaaagtctagaacacagtggaaagcaccagacaacgcgcgaccaaaagggcccaggccccagcgccccagtccgggggttgtgttcgccgacctgtgcgtgcctgctcgtcacgtcacgtccctatttgcccgtcttcctcccctccagacccttctcgaacgccccttcgttctggatccaacggtcggtctctgccgggctcgaacgttctcgaaaccacgtcacccccgataaaaccccacgcacagcctcctcccttcctcaaccatcattgcaaaagcgaagcaagcaatccgaattctctgcgatttctctagatctcgaccacccctactagttttggttcctcctttcgttcgagagagcgtttctagtggca

SEQ ID NO: 226 - DNA, 1500 bp, Zea mays
caacttacaagcgatgaggccaagacgattagacgaatagctacagaacaagacaatgagagttcagcactcactttttgccagttccttctccttggcagcagccaggcgcttgagtttagcagcttgtgcaaatgtggacggcctacagcagacatacaggcaaagaagcgaggagtaatttgcagttggaaatcattcttcgatcaatagggaaactctgagtcacagcgaaaggaaggttaattgcctacgttgacaactgatcagcctccttgagaagttgcttgatttcaagccgcactttgatctgctcatcactaagtcctccgctctggatgacaaaagcacagaacgcatgagtggcaagtggaaacactagagcgaaataaatacaaaaccgcagactacaggctaacagatagggagaccgggaagacaaagactcgagcctgcattcaacagttacagtcgcctcggccaaaggttgagaaatttgcatcaaaatccaaactgtctagggccatgggaaatagttcctcggaatcagagttcaattcatggacgaaatagatggaactgatggtaggctactcttccgcccaatcagaattcacggaagatccaggtctcgagactaggagacggatgggaggcgcaacgcgcgatggggaggggggcggcgctgacctttctggcgaggtcgaggtagcggtagagcagctgcagcgcggacacgatgaggaagacgaagatagccgccagggacatggtcgccggcggcggcggagcgaggctgagccggtctctccggcctccgatcggcgttaagttggggatcgtaacgtgacgtgtctcctctccacagatcgacacaaccggcctactcgggtgcacgacgccgcgacaagggtgagatgtccgtgcacgcagcccgtttggagtcctcgttgcccacgaaccgaccccttacagaacaaggcctagcccaaaactattctgagttgagcttttgagcctagcccacctaagccgagcgtcatgaactgatgaacccactaccactagtcaaggcaaaccacaaccacaaatggatcaattgatctagaacaatccgaaggaggggaggccacgtcacactcacaccaaccgaaatatctgccagtatcagatcaaccggccaataggacgccagcgagcccaacacctagcgacgccgcaaaattcaccgcgaggggcaccgggcacggcaaaaacaaaagcccggcgcggtgagaatatctggcgactggcggagacctggtggccagcgcgcggccacatcagccaccccatccgcccacctcacctccggcgagccaatggcaactcgtcttaagattccacgagataaggacccgatcgccggcgacgctatttagccaggtgcgccccccacggtacactccaccagcggcatctatagcaaccggtccaacactttcacgctcagcttcagca

SEQ ID NO: 227 - DNA, 1500 bp, Zea mays
tctcataaaagcaataaaacaatatctcacaaaatacaagtggcaaacattatacaaacatacacatagtcagaaagtcacaactcaggaccttaaaaaatgaaactatccgattgaaaatacattgataacaattgaacactagaaaataatatcacaaatcaaactatggagcatataactagccatataactcttataatacaataataaaatcatcatatatttaaataaaacactagcaagtctaataacatatgactatagaatcaagatgtgtatgatgacatgacacttgcaattttatcatctcctactactcgacatagtcaatataattgatgtcctccttatctttaaagtttccatgcgaattataaatatatgtatgaagagtaatgattgataagaaactataaataagagtcacaatagttcaaacaactctaaactatatatcattagatagatcttgattttagaaaaataacgaaatcagtttcataattttctaagttaagatgaatttacaaagattagtttagatttaatattttttctgaaaaaataccgatttcggaaacgggcaaaagagatccaaactatttctgtttttttttaccgatttcatttccgtattttcggtaacggtttccggtttcgtatgaccctaaattttggtaaagtttcgaaaaaaaatattttaagaactgaaaattaacgttcctgttttcatccatactaatggctctttaccgctaaaatgttgcccacaatcattgagtaggtttagacgtgagagcaaacagtacaacattacgattcgcccttgcccaaatttacatgccttttccctacggaaacaacatagaatcaagttgacggggttacttacattgaagtggccaaactgatggtagctgtagatttggatgtatgttttctataaattagtcaaaattgagacaaaataaactgcaatttaaaactgaggaaatagtaaaaaaaaggtgaagaagggaggaagaggaaatcagaagcaaaaaatgggcaactttaggcccattatctcgatggtctcgtcggagtccagatatgtgattgacggattggattgggccgtacatcttgcatgagagttcgccaagatttcattgtttaacaagaagcgcgtgacaacaaaaccaagcctatctcatccactctttttttcccttcccacaatggcaagtggcagctcctgattcgctctggccattcctacgtggcacacaccaggattcttgtgtgataggccactgggtcccacccaccaggtgccacatcagacgccaagccatcccggcagaaccaatcccagcccagcaacagatggtctgctatccagttccaactgtataaaagcagctgctgtgttctgttaatggcacagccatcacacgcacgcatacacagcacagagtgaggtaagcatccgaaaaaagctgtgatctgatcgac

SEQ ID NO: 228 - DNA, 1507 bp, Zea mays
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgatcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 229 - DNA, 1996 bp, Zea mays
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctataaagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagg

SEQ ID NO: 230 - DNA, 1500 bp, Zea mays
cgagaatatatgttatcttcgtcgttagagaaatctagacagtatacaacaagatccacgtactacaggtaaacttttaggggtattgtgaacaagaggatgagtaaactctaaaagaacaaagctccaatgaaaatttaggtttttatgtggttagtcatagggcaagttgcaaacaggtgttgatctaaaaaggaagtagtagggaaatgtgaagtgtctttgcgaggaattggaaaatgaagatcacattttctttgggtgcatcatgggaagaaccatttgggactcttttaaggaggcctaagaatgccataaagtttgcaagatctttttgaagagtgtctacctataaacaatagtaaatatcatgtcaaaattttcatcttcgccattattctttaggagaatttagaatgttccgaataaaatatggatagaaaagaagttcccaaagtcatccaattttctacaaaatcttcaactttaagattgagagtgggtgttgtaaagttcttggaagatgagttgaaccccatggaggcgttggctaaagtactgaaagcaatctaaagacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagaggccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggattcacccgttcgcctctcaccttttcgctgtactcactcgccacacacaccccctctccagctccgttggagctccggacagcagcaggcgcggggcggtcacgtagtaagcagctctcggctccctctccccttgctccat

SEQ ID NO: 231 - DNA, 1500 bp, Zea mays
cgataagaacaatgttggacacaacttaagtctgttttacaacaatgtctctcaaaactatagttttacaatattatactttgcaattatcatgacaataatgtagtttcggtagctccaaaaatacagtagttttgagaaacattgtttagatacaatattataaatcatgtattagacaaaagatagccatgccattaaaactttgaattggactgtagttttttcaatactccaaaaatattatggtacctagaatacgatgtctagaaaacatattttttaaaatgcaaccaaacatcatatgacataaataatatagtatttttttgaaaaccatggtattacctaaaaactacagaatacttcattctgaaataggtcctaacaagttgcagcagctaggtcgtacatcagcaaatagctacttcatcaatctcagaataaacatattttatagatgagttaaactaaaaatatagaagaacaacgtacacgcgttgaatcacaacgtagcgcgatatccattcaactttttggaagtttttactgagcacaaattcgaaaatgggaagcgccacgtaacacgagcgctgggccaatttctgccagtgccagttatcccggcccacatccaatcctggggaagacgcgaacccggctccgcggcacgagttgtccgcacgtacggcacgtcggggctggctcgtccgcccgcgagtgggaggccactgtttcctctgcctcaccgggtcgtgtggcggaggggcgtggggccatggttcgcagcgcggggcgacgagcgcgctcctcctctcgcgcagcgccagcgccaccccgcaccgtggctttatatacacccctcctcccaaccctaccgaatcatcactaccaccgctctctcttcctctcctccatctctcaacgcctgaagctcaccgcacctcccctcctcgccgcggatcccccactactccggtaaccgtctctccattcaccctgcctgctgtctcgctagaatcgcctgcctctgccagcgccgtgacgcgggggcgcggtatggctctcccagatccgcctggcattgctcgctcgggtcgtgccaggccgatctgatctcgcatttgctgcgcgctcctcctgctgcggatcccaccggatctcgctggaatcggagcgcgcgtctctttgaaatgccgcagatctgcgtgcttgcgcgcgtgatctaagtccgggcctttcgttaacgaaatggtccgatctgtggtttggtggaggcaatgccatggtttttccccgtgaattttttttgctgattttaggagcttttttctactgtcctatgttagtaggacaaaaaaaaagaaacatagattagcttcaataggcgccttttagaacagattctgtacagcaactcgtggaaacaaatctgcttccttaatgatgttgcttgttttaacaaatgcggcatcgggcgagcttttctgtaggtagaaa

SEQ ID NO: 232 - DNA, 1694 bp, Zea mays
cacggaagatccaggtctcgagactaggagacggatgggaggcgcaacgcgcgatggggaggggggcggcgctgacctttctggcgaggtcgaggtagcgatcgagcagctgcagcgcggacacgatgaggaagacgaagatagccgccatggacatgttcgccagcggcggcggagcgaggctgagccggtctctccggcctccggtcggcgttaagttggggatcgtaacgtgacgtgtctcgtctccacggatcgacacaaccggcctactcgggtgcacgacgccgcgataagggcgagatgtccgtgcacgcagcccgtttggagtcctcgttgcccacgaaccgaccccttacagaacaaggcctagcccaaaactattctgagttgagcttttgagcctagcccacctaagccgagcgtcatgaactgatgaacccactaccactagtcaaggcaaaccacaaccacaaatggatcaattgatctagaacaatccgaaggaggggaggccacgtcacactcacaccaaccgaaatatctgccagaatcagatcaaccggccaataggacgccagcgagcccaacacctggcgacgccgcaaaattcaccgcgaggggcaccgggcacggcaaaaacaaaagcccggcgcggtgagaatatctggcgactggcggagacctggtggccagcgcgcggccacatcagccaccccatccgcccacctcacctccggcgagccaatggcaactcgtcttaagattccacgagataaggacccgatcgccggcgacgctatttagccaggtgcgccccccacggtacactccaccagcggcatctatagcaaccggtccagcactttcacgctcagcttcagcaagatctaccgtcttcggtacgcgctcactccgccctctgcctttgttactgccacgtttctctgaatgctctcttgtatggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcatacggtatttatttaagcacctgttgctgctatagggcacttgtattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgacgataagtcaagatcagatgcacttgttttaaatattgttgtctgaagaaataagtactgacagttttttgatgcattgatctgcttgtttgttgtaacaaaattttaaaataaagagttccctttttgttgctctccttacctcctgatggtatctagtatctaccaactgatactatattgcttctctttacatacgtatcttgctcgatgccttctcctagtgttgaccagtgttactcacatagtctttgctcatttcattgtaatgcagataccaagcgg

SEQ ID NO: 233 - DNA, 1500 bp, Zea mays
tttaaatttggaacgtcgatccaacatctaacagaagcaccaattttacaaagaacccctttcaccttcctcacttggtgggacggttcttaatcaaattaactgcagccgctggtatacatgtacatgtgggcccgcctagcccggcacggcacaggcccacaaaaacacggtccacaaaagcacgacccacaaaagcacatatctaattatgggccgtgccgtgccagcacgtgtgcccagtcatcggcccacaattagttatgtgtgccaggccgacccaaatagcccaaaataccttaatatgccagaccggctcatatacatacaacagtaatacatcaacaaaacgtataaaatatatatatgaccaaaataaaactaagatgttttgtggatgcacattataaacctttggtcagaaagaaaaaaatattacaactagctcacaaaaaatatccagttctctgtttagtgtttaattgagtactatacatccatacagaataaatatacaatgatcatcatcactattcactatccatatctaggtattggttctcgatggcttattaaagctctagattctccaagttatgctagtcatgtgggctttgacagaccttagttaaatactgagtctatattttgtgggccttagttaaatgggtcgtggcaggccggcccgtgggcttgacttgaggcccaggcacggcccacaatgtgggccgtgccggcccatgcccacaattaggttgggcagtgccagatatgggccgtgccagaaattgtgtgctttgggccggcctattaggcacaacataaatgtacacctatagccgcatagccgctggatgtgagatgaatgtctcagatttaaaatgtgcacttgagcaccgtacctctttgaacaacagatatgttcctttaagattgatggtggaaaaaaattagtcagtacctcactgtatggcggcattgtttgattatttcagttcgcacccgttggaccttgctcattaaaaaagtttataccatggagtctttgcatgtagttgtgtagtaggggaagagtggcataggaggaatcacaacttcagctagcttctctagccttagggtatttttgtctttttgcagttcggtcttttcgcagccctgcgctgccccccctgtccgcctgtccctagacctgttttgcgtcggcggggaagacagttgacaggaaggacacgatcttcgtgtccgatgccgatcttcatgcgagcagcgagccactacgttgcgctgccagtgtcggctatggtatccaggcattcgttgtgcacgttgacgatgagctcgaagccggtccgggtgaacgcgagcagcacggtgaggtcaacgtcgtacatccgcacgtcgatgctgaggccagccagcagcggcatgacagattgcggcgtcaggagattgtgccagtaggtggcggggctgggggcagaccggcaggcgaggcct

SEQ ID NO: 234 - DNA, 1500 bp, Zea mays
caaaattttctattttttaaaaaatatgaattctagatttgggattgaacacatctaggctacaacgttgaattgatgaacaatagtgcttgttaataaattgctcacattcacattgtcgctcttacttcaaccatcatacatccatctacagtggtcacccatatttaatcctatggactaaagatgacagatgaacttctctcgttatatatatcactgtcctacatatatgagaaatgatatgtcctaaactcacctaaaaacaacaacatagtttaaatttaatcatagatgagcctacagaggtcgaacgtgatttggaaacatagctctattgttctctatctcatgcataaatatggtgcaatgaagaatattagggttatgatgtcgaaatctcactcgaactcgtgcctcatcataaatagcacactatcaattgttctatggctgttcaaatagggacaatcttgaaacaacatttctcacatgtaaaacgttgtgaagtatgccaactgaaacggatgacacatacacttcgtgaaccaatcgatattttacttgcttctatgttaaataatgttataatacaatattttattcaaatgctaaaacttattactagataaaaataaaatttaattatcttcaaaaactaaccaatagatattccatcataactacatttaccaaactaatatactaaaaaatataggataattactaaattaatcgtgcaataatcagtatttatgagattgataattttaaattttgtgggctacaaacaaaaattaaaacttacttttcaagttggagataagaacaatggtagacgtagctcgggatggtatggcgtcggtgcagacggttaccctttgtgcgaagtggcgcgggcacgagggtggggacttggtacatgcatgagagagaggaagaacgaaacaacttctcaaattaaagcatatgaaaatcacctaatttttgtctgtcggtggaaactaataactagtttttattatcttttttaataaggatccacgaaaattatttttgaccgatgaaaatcctggatcttcgtattatgtttcgccttttcccgactctttgcatgctagatttccatgcttggactaaaacgaagataataaaaccaatctatcattttcacacgatgtattcatacttgcaatagataaaccactactccgacgggatttgctttctgacctctgaaatcttggaaggattatgtgtctacacttctcgatcgaggggaaaaagtcgtagtaccaagttgtagttaaatttgtttcttcgatgacaaaacaaaggagaggggcccgcgcggcgcagcgcagcgcagttggctggttccggaacacgaaaaccaagcacactccaccagctgccatccaccgggttggatggagattacaatactcgaatagtcagccagccagccggcttgaacgtgcagttttcccctataaaacg

SEQ ID NO: 235 - DNA, 1500 bp, Zea mays
acacttgctctcttcgcgtggtcatttagcccccgaacattccaagaaaaaatagcacatttttgattcataaggtaaagactgccactccacttaacacagcacgctgccaccacacatggattagcaggagagcctgctgtaaaatcctaacaggagggagaacctccaaacaagggttcgccgagcaaaaacacagcccgaccacaaccgacaacctgaaagaacaacagagatacacaggcatgctgggggacctagaccagcgcccagaagtaataacgccagcggagatacaaccgctccgagagagcctgaccatctgagaacacattggtcaccaaaagcaccaccaaccggcctagacaaagcagctcagttgacccccgcctcgacatcttcgatggccggcatcacctttctccccttctttttattcttcgctgtcttcaccttgtcttgatttaacagctccatgattgcatccatttgcttcttggagagaggctttgtgagaaggcttgtcatctgctcaaatgactcatcaaagttagtacattttgaagaactaattattattatatagaatgcactgcacatatattactattaccagttttcttgggcacagcagaaaacatgcacacgcagatagaaaaaggagaggccataaaccaaaaggctttaagaatatatgtaaagatatgtctaaatatatggctatatctggttaagcaagataacagggctctggtcatcagtagtagtggccttttgcccttgcccctctctctcacctctcttttctcagccttgcttccgatggatcccatcccactgccatcctttctttcccttgcgcgcattgcctagccggccggccggcctgctattaaaccactttacccgccccctctcgctcacgctcgacgcagctcccttttccttgtttgcttattgcaagtctctgcaagaacctgctagagaggaacaaggtagagtagtatcgcttttttccatctaggttatctctttttacatgaaaaatttcagccgtatttcgttctccatcagtcctgcgataatatatacgcgcgtcttgtgtgatccggcatatgtatagttcctgctaactgatcgagatcgctctcgtttgtactttctccctttgaggaaagagtttccccttttctgtgcttcaagttcttgtaaggaaaaccatgcctgccagcttcttctgctacttgtatgatgattcttatttgcttattacttgatttccgttttttttcttgctttctatatgtatgtatctgggctgtcttcccctgcgtctcgttactgctaagctttggaaggtttcaactctttgtatacgatgaggtttctgctcctagtagcagatccgcgcatatgactagatgtttgaggaaaagaaaagggcaagacgctatatatatatgcagcacgcagtcgcacatatattcagttttccaatct

SEQ ID NO: 236 - DNA, 1500 bp, Zea mays
gattcgcgcgtgctggaactcgggattggattcatgcgtgctggaacttggaagtctggagtggactttggaagcctggattccagaacaagaactcaagaagtctaggagccgccgagcaggtagggaattagggaaataaagagaagaggcggctggcgttcgacgttccatcttcagtagaggcggctggcgtttcaactccctgtagtcgggccgcctgccaaaaaagcccacgaaggcaggaaatcaaaaaatctaggtcctaaacctagtcgcgcagaaccggctaatcgagcgactaatcgaccctaatcgtcgactagtcggacggccagggcgattaggtactctaatcgagtcggttgtgctaatcgagctctgctaaccgactagcccgaccgcgattagtcagatgacttgaaaacaaagatagagacatacttttttatattctttgcattgttttgtttctatccaaaactgctatttagaaattggaaaatctgcacattgaaaaatctaatggattagatatgttgatttgtttttattcacgagcataatcaaataaattagatttagaattggactgcacgcagtgaactactgaactgaactgtgttcaataatttaaatactcacggctgagccgtgagctgtaggctggagcacaagcacgagccagcaccgagcggcggagcactggagcagcaggcgagcagggaggcggccaggcgggagcagccagccagcaagcaggcagcagcggagcagcccacagccgagcgcccaagctggagctgctgcagagcctgcagcgtgccgctgcgcgccggcaggacaggagcggccgagcgggagtgcaggactgtggcctgcgggacgcggggatgggcggacggcgtagcgcttacagtccgcggacagcggactcacggtggcggctaagatagtgagaccgatgacctaatctctatttggaccggttcaaggttttgcccagttaatattggaccatattgggccttccgcccctgctcgcaagacacactgaacaaagaatccacacggctctccaaaagatagagagataattcacatgcttctctctctctgaaaaaaaggaacttgcatggttgacacggaaaacgtcattaaacgcgcacgtggctgcaaatgcaacgtaacagatccatcatctatccatccatagaatcagacggccacagaaggcaacgaccgtgtgcctgtccaccggcgcaggtggcccacagacgcccgtgcgattcatccgtctcggcccaccaaccacgggaggggccccagggccctccttagtccttacaaataccggcagcagcatcacccggccaccaccacccacccgttttatccacgcacggcgtcgaacaccccgcggtcgctcacgtgaggcgccaccccgcgcacccagtcagcgcccgcctccaccacccacccacacgacaaaaatccgcc

SEQ ID NO: 237 - protein, 317 aa, Camelina sativa
MSIQINMTNAQEGFVWGISNSDDSKGGCRKIEKSPPSQPSHPSSEIQTDAVRKVAKGKKRTKRSDENDVEESHDHETHIWTERERRKKMRDMFAKLHALLPQLPPKTDKSTIVDEAVSSIKSLEQTLQKLQLQKLEKLHYSSASTSTTPATTFAYGPSSSSSPATTLPTPISNHPQILTIGAAVEDSYCPAAFLADQIPSSSAVAVNMPYPCNDPIVAFDTWSSRNVVLNICGNEAFFNLCVPKGKLGVFTSVCYLFEKFNLEVLFANVSSNVFGSTYMIQAQVNPSYANQLLGNGVGVGEIFKQVAQELVLYFSSP

SEQ ID NO: 238 - DNA, 708 bp, Camelina sativa
atgagaatcagctgcaacgggtgtagggtcctacgcaaaggttgcaacaaggattgcaccataagaccatgtcttcaatggatcaaatccgcagactcccaagctaatgctacactcttcctcgccaagttctacggtcgagccggtcttcttaacctcatcgaatccggtcctgatcaccttcgtcccgcaatatttaggtcacttctgtacgaggcgtgtggtcggatcgtgaatcctgtggatggttcggtgggtttgatgtggtcagggaactgggcccaatgtcaggcagccgttgacgcggtgctcaacggcttacccataactcacacacctcttccaagtgcatctgcgtctcatcagatcattcctcctcacaggacttatgacatacgccacgtggctaaagatccaacaaccggcggcgacagttcggagagtctggccacacgtgttaacgctaacaagggcaagacacaaactggccgattcaaacgccatgctgagtccgtgaaccaacaaggcgaatgtagtcatgacacatggcaactcccaagttctggtgctacgcatggctatggtcacttcacgttggagactgtggagagtcgaagggaagctccacttgatcaaagttcttcgaatcttgggtttgatgatcaagtcgatatcaacgaggttggcttagagctcagacttggttag

SEQ ID NO: 239 - DNA, 747 bp, Camelina sativa
atgaaaaaaatgttgaaaagtgtaagtccaatggcattctacgatataggtgaccagcaatactctgctttagggtacatcttaagcaagcctgggaatgtaggagcgtacgacatagaccctccgatgccaaccatcgacgatgcgatctacggctcagatgagtttcgcatgtacgcgtacaagatcaaacggtgtcctcgtacccgcagccacgactggactgagtgtccctacgctcaccgcggcgagaaagccacacgccgtgatcctcggcgtcacacttactgcgcagtcgcatgcccggctttcagaaacggagcatgccaccgtggggactcatgcgaattcgcacacggtgtattcgagtactggctccacccggcgcgttacagaacacgcgcttgcaacgccgggaacttgtgtcagaggaaagtgtgtttcttcgcacacgcgccggagcagcttcggcagtctgagggaaagcataggtgcaggtatgcttacaggccagtgagggctagaggcggaaacagtaatggggtggcgatgagattggacggcgaggattacgacacgtcacgatctccggagaaaagcgggaaaagtggtttagatggtaacgaggagaaagtgttgttgaagtgttggagtcggatgagcattgtggatgatcattatgagctgtctgatttggatttcgatttgaatttcggtttggattggatctcagagctggtggattag

SEQ ID NO: 240 - DNA, 636 bp, Camelina sativa
atggataacgtgagtgttttggcaaagggagagaaccaactgaacggagagaagcccccaccggaagtgtgtgcaaggtgtagctctaacaacacaaagttctgctactataacaactatagcatgtctcagccgcgctacttctgcaaggaatgtcgtcgatactggactcaaggtgggactttgaggaacgtcccggttggtggaggttgccgtaagcccaagcgtccaaggatagaacactcctctgtttctcaggtggcttcctttgagaaccaaccagttaatcatcaacctttcagacttgttcatgaaaacaacgagtctgttggactttttggtggttctacttcttcttcctcttctcctgctgctgttgctgccgttcttgggaagcatttgggttatttggctgagtttcgtggtgtaaccaatgtgcctcaagttcgaggtcttcgacctgtactgctggatcgcttggattttgtgcatcagcacaagtggaaccaaagctttgacaacactatgaatgtgaatcatgaagcaagctctagtggaagcagaggatcttccgacaccgagacgaacagcaacaacaacaacaacaacaaagatcagaagcacctgtttgattag

SEQ ID NO: 241 - DNA, 1881 bp, Camelina sativa
atgacttttgctgaatctctccacaacaaaagttctgtcttgagtatcaacatcctagttgtggatgatgatcctgttatccttgaagttcttccaaaaatgcttgtaaagtcgaaatacagagatccatcggttatggagatcaaagttatagctgaagaagacccggtgaaagcattggctattctaaaacttcaacgaaacaatatcgatctcataatcacagattattacatgcctagcatgaacggtctacaactcaaaagacgaatcactgaggaaattggaaatttacctgtcattgttgtatcagcggacgccaacaaggagcaggagagtttaacttgtggagcgctggggttccttccaaaacctatacaagcaactgacctaccaaagatataccaacttgctttaacctgcaagaggaatggtaagtccaactacaaggccgacgacacaggtgctagtgtcccccagcaaatcaagatgcttcctgaacaagctaatgtcttgaagaccaggaagaagtactcatctaaagctgcttccagatccttaaacagtacaaacggaagtggtctaattagtaccgatggttcaagaaaaaatcggaaaagaaaacctaacggtggtagtgaggatggtgctccgtcgcagccatccaagaagactaagatttcgtggacggatggtcttaacgacctattcctacaagctatccgacatattggtcttgataaggctgtgccaaaaaagatcttagcgttcatgaacgtaccatacttgacaagagagaacgttgccagccatttacagaaatatcggatattcttgaggaaagtggcggatcaaggtttgatgagcattatgtcagctagaggcatagactcgatgtttcgacatactcaaatcaaggagtcctacttcaaccgatacacaccctctacttctctgtacgacacaagtcttaacaatagatcaatctattccaaacccggacaaggctttggacagtcgagacttttgtcgaccacacgtgagccacccgtccgtttcaaccagatgccttacaactacatgaaccggtcatctacttacgagacgcaccatgttggttctggatcaaacttgacgctacccatccaaagcaacctcagtctcgccaaccaaccatttcaaaacgaggaattaagaagctttttcaaaccacctgtgatggcgaacaaaatcggccaaacatctcaagttcatgggtttggacaacttggaccgttagctattaatttcaacaataacatgatgagtagctttggaagttttactccaaatcaaccaggacttggccacttctcgtatgggatgcaatcgttcttaaacaatgagaacactgcatataaccctgagccacatgccaatgcaactacacagccaaatcttgaacttcctcaactggaggatctcaacatacacagtggtctcggcaagactaatgagcttccttacaacaccagcaactttcaatccgatcacaacaagcagcaacaaggagaagaggcttccaacaaatttgagctcccatcatttttttcggctgaactgaatcagtttttatctcttgaagacgatagtgactgtacctttgtgaacgtaaatgagggtcattctagtggagaaatagccaacacttttgctgctcctgagacgaatcactcttattttgccgctccggagatgaatcctccaagtttcaacacgaaccctaatcagaatcaggaacaagatgctaatcgagatattagcgattggtcgtttttggatccacaggatttggttgatgacgacttcatgaactctctgttcaacaatgacatgaattga

SEQ ID NO: 242 - protein, 344 aa, Camelina sativa
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKLNNRPPGCDFGNKKNSLRLDDWVLCRIYKKNNAGRHVDNDKDHDMIDYIFRKIPPSLSMAAAATGLHHHHHNVSRSMNFFPGKFSGGGYGIYSDGNTNLYEGGGMINNNMGTDSVPMMMMPNQKRALPVPYWPVAEEEQDASPSKRFHGGGDCSNMSSSMMEETPPMMQQQGGGVLGDGLFRTTPYQLPGLNWYPS

SEQ ID NO: 243 - protein, 551 aa, Camelina sativa
MKNNNNKSSSSSSYDSSLSPSSSSSSHQNWLSFSLSNNNFNSSSNPNLTSSTSDHQHTHPSHLSLFQAFSTSPVDRQDGSPGVSTGDATAVLSIYPGGPKLENFLGGGATTTTTRPMQQMQSLGGVVFSSDLQPPLHPPSAAEIYDSELKSIAASFLGNYSGGHSSEVSSVHKQQQNPLVVPETSPTPKKSVESFGQRTSIYRGVTRHRWTGRYEAHLWDNSCRREGQSRKGRQGGYDKEEKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPQPSPATATTTADKTVDLTPSEPPTLTTPSLTFDVATPVHDHGGTFYHTGIPIKQDPADHYWSNVFGFQANSKAEMRPLATFGSDLHNPYPGYAIMPIMQEGENNFGGSYVGSEGYNNHTVASNPVSAIPLSSTTTMGNGNEGYWISNNNISSSYQNAKSSLSVLQTPVFGLE

SEQ ID NO: 244 - protein, 339 aa, Camelina sativa
METFCGFQKEEEQMDLPPGFRFHPTDEELITHYLHKKVLDISFSAKAIGEVDLNKSEPWELPWMAKIGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPTLLPSLTDSSPYNNDKTKTEPVYVPCFSNQTDQNQGTTTLNCFSSPALNSIQTDIFHRIPLYQTQSLQASTNLLHSPILAQEHSVLHAMIENNRRQSHKTMSVSQETGVSTDMNTDISSDFEFGKRRFDTQEDPSSSTGPVDLEPFWNY

SEQ ID NO: 245 - protein, 347 aa, Camelina sativa
MNSTSTHFVPPRRVGIYEPVHQFGMWGESFKSNIGNGNMNTPSHIIIPANNQKLDNNLSEETSHGTAGTPHMFDQEASTSRNPDKIQRRLAQNREAARKSRLRKKAYVQQLETSRLKLIQLEQELDRARQQGFYVGNGIETNSLGFSETMNPGIAAFEMEYGHWVEEQNRQICELRTVLHGHINDVELCLLVETAMKHYFELFKMKSTAAKADVFFVMSGMWKTSAERFFLWIGGFRPSDLLKVLLPHFDILTDQQILDVCNLRQSCQQAEDALSQGMEKLQHTLADCVAGGQLGGGSYIPQVNSAIDRLEALVSFVNQADHLRHETLQQMYRILTTRQAARGLLAL

SEQ ID NO: 246 - protein, 284 aa, Camelina sativa
MGKGRAPCCDKTKVKRGPWSQDEDLKLISFIHKCGHENWRSLPKQAGLLRCGKSCRLRWINYLRPDVKRGNFSAEEEETIIKLHQSFGNKWSKIASKLPGRTDNEIKNVWHTHLKKRLSSDTTNLNTAEAGSKGSLNEEETSQESSPNASISSFAGSNISSREEDDAQMMSQAFEHIQTYGEFTGMLQEVDKPELLEIPFELDPDMWSFIDGSDSFQQPENSWSQSRAPQEYEEDEIEKWFKHLESELGLEESYLSSSLLKGYELLRRSSPSSTVTCRGFTGVR

SEQ ID NO: 247 - protein, 386 aa, Camelina sativa
MDLTGGFGARSGGVGGGPYREPIGLESLHLGDEFRQLATTTSLTPDNAGGSFTALLELPPTQAVELLHFTDSLSSSQAAAAATTGIGGGDIIIAPPPPPLHSFGGTTLTFPSNSALMERAARFSVIATEQQQNNGNYHNNETPTSSVPSNSSDRVKTEPPETDSAMENQSLCPNQTNRSGKRKDFDKKVKSSTKKNKSSEETEKLPYVHVRARRGQATDSHSLAERARREKINARMKLLQELVPGCDKIQGTALVLDEIINHVQSLQRQVEMLSMRLAAVNPRVDFNLDTILASENASLMDGSFSGTAMQLAWPHQALETEQSFHQRQLQPPPPPPQQWPFDGLNQPVWGREEDQAHGNDHSNLMAVSENVMVGSANLHPNQVKME

SEQ ID NO: 248 - protein, 325 aa, Camelina sativa
MAEPSGGGAREMVMREYRKGNWTVSETLVLIEAKEMEEERRVRRSEKKTENRNKSIELRWKWIEEYCWRRGCQRNQNQCNDKWDNLMRGYKKIREYERSRIESSFNTGSSSSRPASYWKMEKSERKERSLPSNMLSRIYDALAELVEKKTLPYGNGGQILRVCQEFVAPMMAQAMHQIPTTIVLSLQSPPPPQPLVLSHPPLPQPPLFTFHAEPIQPTVDTSGAKRRRTTTPRETTTKQGESTEDAEVMVGAAISRSALVVAQVIKESEERQEMRHKEVMRLQERRLKMEESKADINRQGMSGLVDAINQLATSILALASSSSLP

SEQ ID NO: 249 - protein, 264 aa, Camelina sativa
MGSIRGNIDQEPISQSLTRQNSLYSLKLHEVQTHLGSSGKPLGSMNLDELLKTVLSPAEEEGLVRQGSLTLPRDLSKKTVDEVWRDIQLDKNGNTTTSTTTAHKQPTLGEITLEDLLLKAGVVTETIAPQENVVNIASHGQWVEYHQPGQQQGFMPYPVCEMQEIVMMGGLSDTPKAHGRKRVAGDIVEKTVERRQKRMIKNRESAARSRARKQAYTHELEIKVERLEEENEKLRKLKEVETILPSEPPPDPKWKLRRTNSASL

SEQ ID NO: 250 - protein, 350 aa, Camelina sativa
MAQLPPKIPNMTPHWPDFSSQKLSPFSTPIATASATTTAVQNPSWVDEFLDFSASRRGNHRRSISDSITFLEAPTVSDHASIENHHFDRFDDEQFMLMFTDDDNLHKTPSHINNDNNNILGPTGSSSNTSTPSNSINDDKNEPPSNHDMTNNYKNNNNNINNDEVQSQCKTEPDDGTASTNNSGNSSGNRILDPKRVKRILANRQSAQRSRVRKLQYISELERSVTSLQAEVSVLSPRVAFLDHQRLLLNVDNSALKQRIAALSQDKIFKDAQRSRVRKLQYISELERSVTSLQAEVSVLSPRVAFLDHQRLLLNVDNSALKQRIAALSQDKIFKDGKFSFSLSYSLFTY

SEQ ID NO: 251 - protein, 244 aa, Camelina sativa
MASSGSGTTAGSGSPCGACKFLRRKCASDCIFAPYFSSEQGAARFAAIHKVFGASNVSKLLLNVPIHDRCEAVVTIAYEAQARLHDPVYGCVSHIFALQQQMAYLQAQVMQMKAQIAGHQMSAAGDLRNSSESTNQFMTWQQISGSPIGSAYSTPYNDHHPYYGHVNPNNPVSPQSSLEESFSNTSSDVTTTANVRETHQTGGSVYGHDGLGFHEGYPNKKRSVSYCSSDLGELQALALRMMKN

SEQ ID NO: 252 - protein, 315 aa, Camelina sativa
MGERDDGLGLSLSLGNSQLKEPSLRLNLMPFTASTSSSFPHMHNQINNSHPQKIHHNSWTHLFQSSGIKRTTAERNSDAGSFLRGFDVNRAASSVPVVNLEEEAAVVSSPNSTVSSLSGNKRDLAAARGGGEEHEAERASCSHGGGSDDEDCGNGDGSRKKLRLSKEQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSASANVTAAPPPATVVGRPSPQRSTLWTAISLQQVQRSGR

SEQ ID NO: 253 - protein, 252 aa, Camelina sativa
MGRGRVEMKRIENTINRQVTFSKRRNGLMKKAYELSVLCDAEVALIIFSSRGKLYEFGSVGIPRTIQRYNRCYNCSLGNNKPEETIQSWSQEMTKLKSKYESLVRTNRNLLGEDLGEMGVKELQALERQLEAALTATRQRKTQVMMEEMEDLRKKERQLGDINKQLKIKFESEGHAFKTFQDLWANSAASVGGVTNNSEFPVVSSHPNSVDCNTEPFLQIGFQQHYYVPGEGSSVTKSNVPGETSFVQGWVL

SEQ ID NO: 254 - protein, 264 aa, Camelina sativa
MSGGGNTITAVGGGGGGCGGGGGSSGGGGSSSGSGGGGPCGACKFLRRKCVPGCIFAPYFDSEQGSAYFAAVHKVFGASNVSKLLLHIPVHRRSDAVVTICYEAQARIRDPIYGCVAHIFALQQQVVNLQAEVSYLQAHLASLELPQPQTRPPSLSQQQPLYFAPPPPFSITDIPASVSPLPSTYDLASIFDQTTPSSAWATQQRRFVDPRQQYGVSSSSSAAATIGLGGENSDLQALAHELLHRQGSPPPAATDDSPSRSMSR

SEQ ID NO: 255 - protein, 319 aa, Camelina sativa
MGERDDGLGLSLSLGNSQLKEPSLRLNLMPFTTSTSSSFPHMHNQINNSHPQKIHHNSWTHLFQSSGIKRTAAERNSDAGSFLRGFDVNRAASSVVAVVNLEEEAAVVSSPNSTVSSLSGNKRDLAAARGGGEEHEAERASCSHGGGSDDEDCGNGDGSRKKLRLSKEQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSSSANVTAAPPPPPPATVVGRPSPQRSTPWTAISLQQVQRSGR

SEQ ID NO: 256 - protein, 245 aa, Camelina sativa
MASSGSGTTAGSGSPCGACKFLRRKCASDCIFAPYFSSEQGAARFAAIHKVFGASNVSKLLLNVPIRDRCEAVVTIAYEAQARLHDPVYGCVSHIFALQQQVAYLQAQVMQMKAQIAGHQMSAAGDLRNSSESTNQFMTWQQTSGSPIGSTYSTYDHHPYYGHVNPNNPVSPQSSLEESFSNTSSDVTTTANVRETHVTHQTGGSVYGHDGLGFHEGYPNKKRSVNYCSSDLGELQALALRMMKN

SEQ ID NO: 257 - protein, 261 aa, Camelina sativa
MGSIRGNIEEPISQSLTRQNSLYSLKLHEVQTHLGSSGKPLGSMNLDELLKTVLSPAEEEGLVRQGSLTLPRDLSKKTVDEVWRDIQLDKNGNTTTTTAHKQPTLGEITLEDLLLKAGVVTETIAPQENVVNIASHGQWVEYHQPGQQQGFMPYPVCEMQEIVMMGGLSDTPKAHGRKRVAGDIVEKTVERRQKRMIKNRESAARSRARKQAYTHELEIKVERLEEENEKLRKLKEVEKILPSEPPPDPKWKLRRTNSASL

SEQ ID NO: 258 - protein, 240 aa, Camelina sativa
MDLQLKQWRSQTESEEQPSAAKIPKHVYDQIHSQTPASTALPLFAPEPTSSKLSPDSSSRFPRYLGRAAMDPEPGRCRRTDGKKWRCSRDVFAGHNCSEMKQDSNNINNKRPYESHNGFSNNRSDGGHVLRPFFDDWPRSSLQEADNSSSPMSSATCLSISMPGNSSSDVSLKLSTGNEEEARSNNNGRDQQNMSWWSGGGSQHHHHHMGGPLAEALRSSSSSSPTSVLHQLGVSTQAFH

SEQ ID NO: 259 - protein, 388 aa, Camelina sativa
MASSNRHWPSMFKSKPHPPHQWQHDINSPLLPSASHRSSPFSSGCEVERSPEPKPRWNPKPEQIRILEAIFNSGMVNPPREEIRRIRAQLQEYGQVGDANVFYWFQNRKSRSKHKLRLLHHSKHSLPQSQPQPQPQPQQQSLSSANSASSSSSSSSSSSKSTKPRKNKNKNNTNLSLGSSQMMGTMFPPEAAFLFPVSTVGGFEGITVSSQLGFLSGDMIEQQKPAPTMGPCTGLLLSEIMNGSVSYGTHHQQHLSEKEDEEMRMKMLQQPQPQICYATTSQQITCYNNNNNIMLHVPPTTSTTTTITTSHSLATVPSTSDQLQVQAGARIRVFINEMELEVTPGPFNVRDAFGEEVVLINSAGQPIVTDEYGVALQPLQHGASYYLI

SEQ ID NO: 260 - protein, 256 aa, Camelina sativa
MEKRSSTKNRGVLRLPPGFRFHPTDEELVVQYLRRKVTGLPLPASVIPETDVCKSDPWDLPGDCDSERYFFSTKEAKYPNGNRSNRSTGSGYWKATGIDKQIGKKTLAVGMKKTLVFYKGKPPNGTRTNWGQNMNWVLCRVFLKKRSNSNKRKEEERDELENEKETEKESEEEKKKSSTCPIFYDFMRKDKKNKIRRRRCCDLNLTPATSCCCCCFCSSSSGSSSSVCSSALTQTSSNDSYHEEISCQENKFCLFL

SEQ ID NO: 261 - protein, 282 aa, Camelina sativa
EDLRSHNPLFLDFLLIHFKILWLDTCYFLSLRSMEGSSKGLTKGAWTAEEDSLLRQCIEKYGEGKWHQVPFRAGLNRCRKSCRLRWLNYLKPSIKKGRLNSDEVDLLIRLHKLLGNRWSLIAGRLPGRTANDVKNYWNTHLSKKYEPGCKTKMKKKNIISPPTTTTVQKVNVFKPRPRSFTVNKDCSHLNVLPEVDITPSSNGLSIDNVCEDSITSDKDDEKDDFLNILINEDDMWLENLLDDSQETDAVVPEATTNEQGATLAFDVEQLWSLFDGETVELD

SEQ ID NO: 262 - protein, 234 aa, Camelina sativa
MRMSCNGCRVLRKGCSDNCSIRPCLQWIKSAESQANATVFLAKFYGRAGLMNLLSTGPDHLRPGIFRSLLYEACGRIVNPIYGSVGLLWSGNWHLCQAAVEAVMRGSPVTPIACDAAVTSQAPPFNNNKLSDIRHVSSKDENVKRRSRGACKGERNVRSQSHESSLSHESPVSSEGTTTEEPKSWIGLELTLGLEPLARGSHVVVPMKKRKLERCGTSEDEDTCKIELGLVCSE

SEQ ID NO: 263 - protein, 364 aa, Camelina sativa
MLDLNLKIFSSYDENQDRKVPFMISTTGEEESNFSSSNSSTTDSAAGDAFITFGILKRDDDVTPPPPPPKETGDLFPVADARRSIEFTVEDSHWLNLSALQRNTQKVLKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKVSYQHRSSTYPLTLFFLGNAHNDLELSLGISSSSENMKLTTGDNYKGINWSTMGLFGKQPSIYLPMTTATMKPLKTVAASSGFPFISMTTSSSSMSTCFDP

SEQ ID NO: 264 - protein, 391 aa, Camelina sativa
MDLQLKQWRSQTESEEQPSAAKIPKHVYDQIHSQTPASTALPLFAPEPTSSKLSPDSSSRFPKMGSFFSWAQWQELELQALIYRYMLAGAAVPQELLLPIKKSLVHLSPSYFLHHPLQHLPHYQPAWYLGRAAMDPEPGRCRRTDGKKWRCSRDVFAGHKYCERHMHRGRNRSRKPVETTPTTVNATATSMATSAAATATATTTSTTASTFAFGGGGDEVVGQGGGSFFFSASSNSSSSELLHLSQSCSEMKHDSNNINNKRPYESHNGFSNNRSDGGHVLRPFFDDWPRSSLQEADNSSSPMSSATCLSISMPGNSSSDVSLKLSTGNEEEARSNNNGRDQQNMSWWSGGGSQHHHHHMGGPLAEALRSSSSSSPTSVLHQLGVSTQAFH

SEQ ID NO: 265 - protein, 262 aa, Camelina sativa
MGSIRGNIEEPISQSLTRQNSLYSLKLHEVQTHLGSSGKPLGSMNLDELLKTVLSPEEEGLVRQGSLTLPRDLSKKTVDEVWRDIQLDKNGNTTTTTTAAHKQPTLGEITLEDLLLKAGVVTETIAPQENVVNIASHGQWVEYHQPGQQQGFMPYPVCEMQDIVMMGGLSDTPKAHGRKRVAGDIVEKTVERRQKRMIKNRESAARSRARKQAYTHELEIKVERLEEENEKLRKLKEVEKILPSEPPPDPKWKLRRTNSASL

SEQ ID NO: 266 - protein, 244 aa, Camelina sativa
MASSGSGTTAGSGSPCGACKFLRRKCASDCIFAPYFSSEQGAARFAAIHKVFGASNVSKLLLNVPIHDRCEAVVTIAYEAQARLHDPVYGCISHIFALQQQVAYLQAQVMQMKAQIAGHQMPAAGDLRNNSESTNQFMTWQQISGSPIGSTYSTPYSDHHPYYGHLNPNNPVSPQSSQEESFSNTSSDVTTTANVRETHQTGGSVYGHDGLGFHEGYPKKKRSVSYCSSDLGELQALALRMMKN

SEQ ID NO: 267 - protein, 160 aa, Camelina sativa
MEKRSTTIKNRGVLRLPPGFRFHPTDEELVVQYLRRKVTGLPLPASVIPETDVCKSDPWDLPGDCDSERYFFSTKEAKYPNGNRSNRSTGSGYWKATGIDKQIGKKTLAVGMKKTLVFYKGKPPNGTRTNWVLHEYRLVDSQQESSHVRYSQILESVIYY

SEQ ID NO: 268 - protein, 332 aa, Camelina sativa
MRMSCNGCRVLRKGCSDNCSIRPCLQWIKSAESQANATVFLAKFYGRAGLMNLLSTGPDHLRPGIFRSLLYEACGRIVNPIYGSVGLLWSGNWHLCQAAVEAVMRGSPVTPIACDAAVTSQDPPFNNKKLCDIRHVSSKEENVKRRSRGACKGERNVRSQSHESSLSHESPVSSEGTTTYGSVGLLWSGNWHLCQAAVEAVMRGSPVTPIACDAAVTSQAHPFNNNKLCDIRHVSSKEENVKRRSRGACKGERNVRSQSHESSLSHESPVSSEGTTTEEPKSWIGLELTLGLEPLARGSHVVVPMKKRKLERCGTSEDEDTCKIELGLVCSE

SEQ ID NO: 269 - protein, 601 aa, Camelina sativa
MNEETMTTVENRTVLGNLKKQLAVSVRNIQWSYGIFWSVSASQPGVLEWGDGYYNGDIKTRKTIQAAEVKVDQLGLERSEQLRELYESLSLAESSASGGSQVTRRASAAALSPEDLTDTEWYYLVCMSFVFNIGEGIPGGALSNGEPIWLCNAQTADSKVFTRSLLAKSASLQTVVCFPFLGGVLEIGTTEHITEDLNVIQCVKTMFLEAPPYATISTRSDYQEVFDPLSDDKYIPVFATEAFPTASTSEFEQEPEDHDSFINDGGASQVQSWKFVGEELSNCVHQSLNSSDCVSQTFVGTTGRVACDPRKGRVQRLGQIQEQSNHVNMDDDVHYQGVISTIFKTTHQLILGPQFQNFDKRSSFTRWKRSSSVKTSVEKSQKMIKKILFEVPLMNKKEGLLPDTPEETGNHALCEKKRREKLNERFMTLRSIIPSISKIDKVSILDDTIGYLQELQKRVQELESCRESADTETRMTMMKRKKPEDEDERASANCMNSKRKGSDVNVGEDEPVDTGYAGLTDNLRISSLGNEVVIELRCAWREGILLEIMDVISDLNLDSHSVQSSTGDGLLCLNVNCKHKGKKMATTGMIQEALQRVAWIC

SEQ ID NO: 270 - protein, 262 aa, Camelina sativa
MGRGKIEIKRIENANSRQVTFSKRRAGLLKKAHELSVLCDAEVAVIVFSKSGKLFEFSSSGMKKTLSRYGNYQSSSDSKVENLQEEDCAEVDLLKDEISKLQKKHLQLQGKGLNILNFKELQNLEQQLHHALLSVRERKERLLAIQLEESRLKEQRAELENETLRRQVQELRSFLPSFTHYVPSYIKCFAIDPRNAVLNHGCLDDSNCSLQKTNSDTTLQLGLPGDAHAHDRRKNEGDRESPSSDSVTTNTTTATADRISLV

SEQ ID NO: 271 - protein, 703 aa, Camelina sativa
MDSSRDDSSSDERGNSTDTNNNQDRRNYHRHTNQQIQRLEAYFKECPHPDDLQRRQLGEELNLKPKQIKFWFQNKRTQAKSHNERESNAVLRAENMRMRRENATMEDALKNVVCGPCGGRGFGREEKQRNIQKLRAENAFLKSEFERFSNFLAQRGGHSMPSVGAFTYPHGPSTSNNRRASYGTSSNHLPQPSCSLRGPYARGNISINQPHQLRKEMPLQHFPPLSQMEKLVMFETAEKAVAEVMNLIQMEELWKKSSIDDRLVIDPTNYEKCFAKISHFKGPSGRSESSKEVVVVQTDARILVDMFLDTEKWARLFPTIVNEAKNIRVLDSMDNGRQTLARVIYEQMHILSPLVPPREFIILRSCQQMEENVWMIADVSCNLPNVAFESMAPICTKHPSGVLIESLPNGCSKVTWIEHVEVTDKTRPHRLYRDLFLYGGLGYGARRWTVTLEKMCERLYLSSISDFPNNDYAGVVQTIEGRRSVMKLGERMLKDFAWMIKMEKKLDFSQQSETNSSGVTIAMRLNNEAGQPPGLILCAGSSLCLPLPPPQWDVLCNGNPVTEVARFVTGTDKKNNVNFIETSSGGDNNSNLMILQDGSIDALGGMVVYAPMGLETAAIASAGQVDPSTIPILPSGFIISRDGRPSSAEDPDGGSSTLLTVAFQILVCDPNHSAAFNVEESAATVNNVISSTVQRIKAMLNCD

SEQ ID NO: 272 - protein, 674 aa, Camelina sativa
MNSMNNWLGFSLSPHDQNHHHTDLDSSPTTTAVDVAGEYCFDLAAAASDGSSAVQTSFASPFGVVLEAFTRDNNSHSRDWDINSGACNTIHNNEPNGPKLENFLGRNSTIYNTNENVGDGSGGCGGDGGGGGSLGLSMIKTWLSNQPVANGNHQDNRNGARGLSLSMNSSTTCDSNNNNNNNDVVQEKTIVDVVEATPKKTIESFGQRTSIYRGVTSLGHSNGDGGGGGSLGLSMIKTWLSNQPVANGNHQDNRNGARGLSLSMNSSTTCDSNNNNNNNDVVQEKTIVDVVEATPKKTIESFGQRTSIYRGVTRHRWTGRYEAHLWDNSCKREGQTRKGRQGGYDKEEKAARAYDLAALKYWGTTTTTNFPMSSYEKEVEEMKHMTRQEYVASLRRKSSGFSRGASIYRGVTRHHQHGRWQARIGRVAGNKDLYLGTFGTQEEAAEAYDIAAIKFRGLSAVTNFDMSRYNVKAILESPSLPIGSSAKRLKEVNSPVPSMMISNNVSESASNVGGWQNAAFQHHQGMDLSVLPQQQERYVGYYNGGNLSSESTRVCSKQEEEQQRFLSNSIDHHSSTSDDSVTVCGNVVGYGGYQGFAIPVGTSVNCDAFTAAEIAYNARNHYYYAQRQQQQQIHQQIPEGDFPVAISNNVGSNMYYHGECGGEGASMFTVWNGT

SEQ ID NO: 273 - protein, 466 aa, Camelina sativa
MERYGGAGEEEPRSDPSLEWSAPGNETGIEASMWRLGLQGGGGDDSLPERPDEPDCIYFIRTGGCGYGSRCRFNHPPDRAPVLGGGLRTEAAGQFPERMGQPVCQHFMRTGTCKFGASCKYHHPRQGGGGGGRGDSVIPISLNYMGFPLRPGEKECSYFMRTGQCKFGSTCRFHHPVPPGVHAPSAGPTMYPSLQSQSVVPSSQQYGVVLARPQLLPGSYVPSPYGYGQMVLPPGMVPYSGWNPYQASVSAIPSPGTQPSMGTSSVYGIRPLSPSAPAYQSGPSSTGISNKEQTFPQRPEQPECQYFMRTGDCKFGSSCRFHHPMEAASPKDITLSHIGLPLRPGAAQCTHFAEHGVCKFGPACKFDHSIRSSSLSYNPSASSLTDMPVAPHPLGSSSLGTLAPTSSSSSSEQRTKLLSSSSIKPITTRAGGTGTVPSSTTSGVSHPEPAETNKDNSASIEAKTSG

SEQ ID NO: 274 - protein, 588 aa, Camelina sativa
MAPMTNWLTFSLSPMEMLRSSDQSQFVSYDASSAASSSPYLLDNFYGWTNQKPQEFFKEEAHLAAAASMADSTILTTFVDPQSHTQSHIPKLEDFLGDSSSMVRYSDNSQTETQDSSLTQIYDPRHHHNHNQTGFYSDHHDFKTMAGFQTAFSTNSGSEVDDSVSIGRTHLAGEYLGHVVESSSGPDLGFHGGSNNNTNTTGGALSLAVNVNNSTNQHRNDNEITNHHYRGGGERNNNNNNNNENSEKTESEKEKPIVAVETSDCSNKKIADTFGQRTSIYRGVTRHRWTGRYEAHLWDNSCRREGQARKGRQGGYDKEDKAARAYDLAALKYWNATATTNFPITNYSKELEDMKHMTKQEFIASLRRKSSGFSRGASIYRGVTRHHQQGRWQARIGRVAGNKDLYLGTFATEEEAAEAYDIAAIKFRGINAVTNFEMNRYDVEAIMKSALPIGGAAKRLKLSLEAASSEQKPILGHQLHHFQQQQQQLQLQSSPNHSSINFALCPNSAVQSQQIIPCGIPFEAAALYHHQQQQQQQQQQQQNFFQHFPTNAASDSTGSNNNSNVQGSMGLMAPNPAEFFLWPNNQSY

SEQ ID NO: 275 - protein, 315 aa, Camelina sativa
MLKSVSPMAFYDIGDQQYSALGYIVSKPGNVGAYDIDTPMPTIDDAIYGSDEFRMYAYKIKRCPRTRSHDWTECPYAHRGEKATRRDPRRYTYCAVACPAFRNGACHRGDSCEFAHGVFEYWLHPARYRTRACNAGNFHDWTECPYAHRGEKATRRDPRRHTYCAVACPAFRNGACHRGDSCEFAHGVFEYWLHPARYRTRACNAGNLCQRKVCFFAHAPEQLRQSEGKHRCRYAYRPVRARGGNSNGVAMRLDGEDYDTSRTPEKSGKSGLDSNEEKVLLKCWSRMSIVDDHYEPSDLDFDLNFHLDWISELVD

SEQ ID NO: 276 - protein, 341 aa, Camelina sativa
MLDLNLKIFSSYDADQDRKVPFMNSTTGEEESNSSSTTDSAAGDAFITFGILKRDDDVTPPPPKETGDLFPVADARRSIEFSVEDSHWLNLSSLQRNTQKVLKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGDGAMKFGAHIKGNAHNDLELSLGISSSSENMKLTTGDYYKGINWSTMGLFGKQSSIYLPMTTATMKPLKTVAASSGFPYISMTTSSSSMSTCFDP

SEQ ID NO: 277 - protein, 252 aa, Camelina sativa
MIGGSMEEGGSSHEADNSKKIGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNDMLVAEIEYMQKREMELQHDNMYLRAKIAEGARLNPDQHESSVIQGTTIYESGVSSHQSHHYNRNYIPVNLLEPNQQFSAQDQTPLQLV

SEQ ID NO: 278 - protein, 216 aa, Camelina sativa
MSSQPNHQTSISSLLHDRLHIPAETIIEKESAEKDTCQSQRKRKEPVLHEVDGGSSSGSAAAKKLDHNAKERLRRMRLHASYLTLGTLLPDHSSSSKKKWSAPSIIDNAITYIPKLQNEVGELTLRKDKLVELERRGPSIRAISVLELGESGYEAVVQICLKKENEDEFSNLLHVMEVQGLSILSASTSLVCREQRVVCYNFHVKVCLLFIFFISL

SEQ ID NO: 279 - protein, 391 aa, Camelina sativa
MPIKSQKLCFFKSFNCFFFSSAVMISQREEREEKRVMGDKKLISSSSSSSIYDTRNHHLPPPSSSSDEISLFLRHIFDRSSPNLPSYYSPATTTTTTTSSMIGVHVDPHADNSRCFVSDAAALMSSKRVGDFSEVLVGGSPAVGSASTAACFGFNNNAQGNSSGTRVSSSSVGASGNETDEYDCESEEGGEAVVDEAPSSKSGGPPSRTSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTPSVMNREGGLTHQRLNIGQSNTNLTGEQAVFDGQQPDLKDRLT

SEQ ID NO: 280 - protein, 284 aa, Camelina sativa
MEENCEDCMQWEEELYWTHFQTLHFSQLLLPGFHHCLVIPQKFSIHCKRKLPQIVTLKSPSGAIYNVRVEQDDVEKTLAFRCGWDKFVKDHSLKGNDLLVFKFHGVSEFEVLIFDGQTLCERPASYFVRKCGHADKTKGTDFTATSSRSPEIHFNPVDLETTPNQQRLITPPVVDNELEDLIDIDVEIDTMLTPRLVVSQTGYDQEEHFNSDIDTASAQLPVISPTSTGRVSKEKYPLSGLKKMRGEISNDSLDHKLGMKIFLLIDYTLHQFLGIHLICPVPGP

SEQ ID NO: 281 - protein, 187 aa, Camelina sativa
MPSSPPKAPFLRSLPKETHEDQRFKCYKGVRKRAWGKWVSEIRVPKTGKRIWLGSYDAPEMAARAYDAALFCIKGEKGVFNFPTDKKPQLPEGYVRPLSKQEIQTISTNYAYSVVHVPSHATTLTVTSQVPSEVSVSPDVSASTEITKVVNEYYLPTDATAESIFSVEDLQLDNFLMMDIDWINNLV

SEQ ID NO: 282 - protein, 218 aa, Camelina sativa
MNSSFSAFSEMFGGSDYESSVSSGGGDYSPTLATSCPKKPAGRKKFRETRHPIYRGVRRRNSGKWVCEVREPNKKSSIWLGTFPTAEMAARAHDVAAIALRGRSACLNFADSAWRLRIPKSTCAKEIQKAAAEAALAFQDEMMSESTTDHGLDMEETLVEAIVTAEQSEGFYIDEEAMFGMPSLLASMAEGMLLPLPSVQWNHNYGIDGDDDVSLWSY

SEQ ID NO: 283 - protein, 358 aa, Camelina sativa
MGDKKLISSSSSSSSIYDTRNHHHQPPPSSSSDEISLFLRHIFDRSSPNLPSYYSPATTATTMIGVHGDPHADNSRCFVSDAAAAALMSSKRVGDFSEVLVGGSSAVGSASTAACFGFNNSNAQGNSSGTTRVSSSSVGASGNETDEYDCESEEGGEAVVDEAPSSKSGGPPSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPMLNHTNQFASTSNAPEMINTVASSYALEPSIRSHFGPFPLLTPPVEMNREGGLTHQRLNIGHSNTNLTGEQAVFDGQQPDLKDRLT

SEQ ID NO: 284 - protein, 329 aa, Camelina sativa
MTLEALSSNGLLNFLLSETLSPTPFKSLVDLEPLPGNDVIISKNTIMEDISRQESPPPPRQPPATNRGKKRRRRKPRVCKNEEEAENQRMTHIAVERNRRRQMNQHLSVLRSLMPQPFAHKGDQASIVGGAIDFIKELEHKLLSLEAQKLHNAKLNQSVTTSTSQDSNGEPENPHQQSPLSISQFFLHSYDPSQESRNGSTSSVKTALEDLEVTLIETHANIRILSRRRGFRWITMATPRPPQLSRLVAALQSLSLSVLHLSVTTMDTYVIYSISAKVEESCQLSSVDDIAGAVHHMLSIIEEEPICCSSMSELPFDFSLNHTNATHSL

SEQ ID NO: 285 - protein, 557 aa, Camelina sativa
MKNNNNKSSSSSYDSSLSPSSSSSSHQNWLSFSLSNNNNNNFNSSSNPNLTSSTSDHQHPHPSHLSLFQAFSTSPAERQDDSPRVSTGDATAVLSIYPGGPKLENFLGGGATTTTTRPMQQMQSLGGVVFSSDLQPPLHPPSAAEIYDSELKSIAASFLGNYSGGHSSEVSSVHKQQQNPLVVPETSPTPKKSVESFGQRTSIYRGVTRHRWTGRYEAHLWDNSCRREGQSRKGRQVYLGGYDKEEKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPKPSQATATTTAEKTVDLTPPEPPSLTTPSLTFDVATPVHDHGGTFYHTGIPIKPDPADHYWSNVFGFQANTKAEMRPLGTFVSDLHNPSPGYAIMPLLQEGENNFGGAYVGAEGYYNNHSSASSTVSAIPLSSTTAIGNANEGYWINNNNISNSYQNAKSNLSVLQTPVFGLE

SEQ ID NO: 286 - protein, 369 aa, Camelina sativa
MNSTSTHFVPPRRVGIYEPVHQFGMWGESFKSNIGNGNMNTPSHIIIPANNQKLDNNLSEETSHGTAGTPHMFDQEASTSRNPDKIQRRLAQNREAARKSRLRKKAYVQQLETSRLKLIQLEQELDRARQQGFYVGNGIETNSLGFSETMNPGIAAFEMEYGHWVEEQNRQICELRTVLHGHINDVELCLLVETAMKHYFELFKMKSTAAKADVFFVMSGMWKTSAERFFLWIGGFRPSDLLKVLLPHFDILTDQQILDVCNLRQSCQQAEDALSQGMEKLQHTLADCVAGGQLGGGSYIPQVNSAIDRLEALVSFVNQADHLRHETLQQMYRILTTRQAARGLLALGEYFQRLRALSSSWATRHREPT

SEQ ID NO: 287 - protein, 319 aa, Camelina sativa
MSSHTNLPSPKQVPKPDNRITGTSQTKKPPSSSVAQDQQTLKCPRCNSPNTKFCYYNNYSLSQPRHFCKSCRRYWTRGGALRNVPIGGGCRKTKKSVKPSTSSMNAVLPSSSSSSQRFFSSIMDDSSKFFPPPTTMDFQLAGLSLNKINDLQLLNNQEVLDLRPMVSSGRENTPVDVGSGLSLMGFGDYNSNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 288 - protein, 395 aa, Camelina sativa
MPIKSQKLCFFKSFNCFSSAVMISQREEREEKRVMGDKKLISFSSSSSSIYDTRNHHHHPPPPPPSSSSDEISLFLRHIFDRSSPNLPSYYSPATTTTTMIGVHGDPHADNSRCFVSDAAAALMSSKRVGDFSEVLVGGSSAVGSASTAACFGFNNNNNVQGNSSGTRVSSSSVGASGNETDEYDCESEEGGEAVVDEAPSSKSGGGPPSRSSSKRCRAAEVHNLSEKRRRSRINEKMKALQSLIPNSNKTDKASMLDEAIEYLKQLQLQVQMLTVRNGINLHPLCLPGTTLHPLQLSQIRPQEATNDPLLSHTNQFASTSNAPEMINTVASSYALEPSIRSHFGPFPLLTPSVEMNREGGLTHQRLNIGHSNTNLTGEQAVFDGQQPDLKDRLT

SEQ ID NO: 289 - protein, 342 aa, Camelina sativa
MAHSLTSLAIFQSLIRKEAVRSLHVYGSVEIEREFLFESESPYVEKEAKPLFLLEGSRRPEISEGSVFGTWRCIFLFRFNHPLPRFPTLLCPSRNPKLEDIPNLANDLKFISGSQPKTPSKVSDQEQCTSVGYCKSDQTKLLKLESEDDSVRDCEVDQPKPPRIVLKQDLNCLPDSESESEESENEKTEHSESDENVKMLMGKRTPSKIVAGLSLKDLSKYFGLTIVEASRSLNVGLTVLKKKCREFGIPRWPHRKIKSLDSLIHDLQREAEREQENSEAAAMAVAKKQKKLETEKRNIVERPFMEIQKETKRFRQINFKKRHRASRAKKNQESLVSNSSST

SEQ ID NO: 290 - protein, 419 aa, Camelina sativa
YLSVVATGKRERKKMEENCEDCMQWEEELYWTHFQTLHFSQLLLPGFHHRLVIPQKFSIHCKRKLPQIVTLKSPSGAIYNVRVEQDDDEKTLAFRSGWEKFVKDHSLKENDLLVFKFHGVSEFEVLIFDGQTLCERPASYFVRKCGHADKTKGTDFTATSSRSPEIHFNPVGVETSPNQQRLISPPVVDNELEDLIDIDVEIDTMLTPRLVVSQTGYDQEEHFNSDIDTASAQLPVISPTSTGRVSKEKYPFSGLKKMRGEISNDSLDHKPGFENVTVIKTWSNLVLSLGYSMILEIRNKALSLAQRVVLPDGFMVVMKRSHVSKCFLTIPYKWCLKNNLLARQEVVMQVDQKKWVMKFNFFGSRGRGGISTGWKKFVQDNNLRESDVCVFEPTNSETKPLHLHVYIFRAAEAESSNNG

SEQ ID NO: 291 - protein, 187 aa, Camelina sativa
MPSSPPKAPFLRSSPKESHEDQRFKCYKGVRKRAWGKWVSEIRVPKTGKRIWLGSYDEPEKAARAYDAALFCIKGEKGVFNFPTDKKPQLPEGYVRPLSKHDIQTISTNYAYSVVHVPSHATTLTVTSQVPSEVSVSPDVSASIEITEVVDEYYLPTDANAESMFSVEDLQLDNFLMMDIDWINNLV

SEQ ID NO: 292 - protein, 617 aa, Camelina sativa
MAPMTNWLTFSLSPMEMLRSSDQSQFVSYDASSAASSSPYLLDNFYGWTNQKPQEFFKDEAQLAVAASMADSTILTTFVDPQSHSQSHIPKLEDFLGDSSSMVRYSDNSQTETQDSSLTQIYDPRHHQNHHHNQTGFYSDHHDFKTMAGFQTAFSTNSGSEVDDSASIGRTHLAGEYLGHVVESSSGPDLGFHGGSNNTTNTGGALSLGVNVNNSTNQHRNDNEITNHHYRGGGERNNNNNNNNNENNEKTESEKEKPIVAVETSDCSNKKIADTFGQRTSIYRGVTRHRWTGRYEAHLWDNSCRREGQARKGRQELWLSLVLSFCMCYSIWGCILALLCINSGYDKEDKAARAYDLAALKYWNATATTNFPITNYSKELEDMKHMTKQEFIASLRRKSSGFSRGASIYRGVTRHHQQGRWQARIGRVAGNKDLYLGTFATEEEAAEAYDIAAIKFRGINAVTNFEMNRYDVEAIMKSALPIGGAAKRLKLSLEAASSEQKPILGHQLHHFQQQQQQQQQLQLQSSPNHSSINFALCPNPAVQSQQIIPCGIPFEAAALYHHQQQQQQQQQNFFQHFPANAASDSTGSNNNSNVQGSMGLMAPNPAEFFLWPNNQSY

SEQ ID NO: 293 - protein, 203 aa, Camelina sativa
MRKKVSSTGEEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDPKTKQSNGDIVYQINLPNPTETSEATKITNIDGNNNILGDVIQEDRQGSNYLSSLWVHEDEFELSTLTNMMDFIDGHCF

SEQ ID NO: 294 - protein, 576 aa, Camelina sativa
MNSMNNWLGFSLSPHDQNHHHTDLDSSTTTTAVDVAGEYCFDLAAAASDGSSAVQTSFASPFGVVLEAFTRDNSSHSRDWDINSGACNNIHNNEPNGPKLENFLGRTSTIYNTNENVGDGSGGCGGDGGGGGSLGLSMIKTWLSSQPVANVNHQDNGNGARGLSLSMNSSTTCDSNKYNNNNDVVQEKTLVDVVEATPKKTIESFGQRTSIYRGVTRHRWTGRYEAHLWDNSCKREGQTRKGRQGGYDKEEKAARAYDLAALKYWGTTTTTNFPMSSYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKEVNSPVPSMMISNNVSESASNVGGWQNAAFQHHQGMDLSVLQQQQERYVGYYNGGNLSSESTRVCSKQEEEQQPFLSNSIDHHSSTSDDSVTICGNVVGYGGYQGFAIPVGTSVNCDAFTAAEIAYNARNHYYYAQQQQQQQIQQIPEGDFPVAISNNVGSNMYFHGEGGGEGASMFTVWNGT

SEQ ID NO: 295 - protein, 260 aa, Camelina sativa
MDQEGASQSTSTSTEPVRSRWSPKPEQILILESIFNSGIVNPPKDETVRIRKMLEKFGAVGDANVFYWFQNRRSRSRRRQRQLQAATAAPATSGGDQHMTAMSMHQYPYSNSEIDLGFGSCINSSANYFLNGTTSSSQVSSFLLGLSSSSGVCETNGMENLFTMHGHESHHHHQHSSNAHSMFSSSDENSNFQYQQGLMTVFINGVPTEVTKGTIDMKATFGEDSVLLHSSGLPLPTDEFGFLMHSLQHGQAYFLVPRQT

SEQ ID NO: 296 - protein, 163 aa, Camelina sativa
MGRRKVTHQLIADNATRRVTFRKRKDGLLKKINELTILCGLPACAIIYSEYKDGPELWPNVNEVRSLLDRLSELPVEKQTKYMMDQKDLMKKMIQEAEKKLEKEKWYTRAMKLGIMASTSDLTTDTDCSEELAKAAEVVDKKLKAIRERIKAVEAGAPIIKRE

SEQ ID NO: 297 - protein, 825 aa, Camelina sativa
MADQSLHSPIKPHFFKPLLPGFRTHLDIPVAFFSKYVEGRNDQNKTAKLRSDASDITWLVKMDGLKFTDGWEDFASAHDLRTGDIVVFRHEGEMVFHVTPLGPSCCEIQYTSSSSHNINDDDETNIVSRNSSRVKKNSRKKMECSSNPFRFVAKVSAWGLSNDRQYIPITFARSKGLNKMRGKKIYLRNEEGRSWKLGLEHDKTGIHTYLTSGWRIFCDANGISQGQQHTFKLVRRSAPPVIRLCRPKPRPKQRSESESPLDHSCFQGSVSPSSLSNDQLYLPRSFVSLHGLEKRCSEIILKNEQGSKWPLVLKHTKSINLTYLKKGWTIFCDFNGFKIGDPFKFKLSGTWEEPVLSLCPVEPNRAKNPLKCSAGSDDVNPEESEEDKNISQECLEIKKRKYRSRCRASVENMDDDQTNIVTGNSSRAKKGPRKTVESSSDHLSFVGNVTASSLRNDRLYLPLSFERSNGLDKMSGKKIVLLNEEGRSWKLNLAYNKAGMHTYVRSGWKSFCDANGMSQGQQYTFKLVRRTAPPVMRLYLAKHRPKPESSSQHSYFVGSVSASSLNKDKLYLWRSFVSSNGLDKGCNKITLKNERGREWTLVLKHYESKRFTIIKRGWTSFCQDNGLKARDSFKFKLVETGENPILSLCPADSNRDKTPLEYAEGIDNVKSLSSSPSSGDDSSRSKKSEDESIEDKNISQDCLEIKKRKYCLNCRASYSYTPKQFVTLTLTQSAFETSKLFLPCGFTKVNGINKPRKITLLGQDGVKRVVDLYQEKKGGTMRFGKGWKQFCEAQGVKVDESFMLELIWEDEASPVLKFCTKVNSA

SEQ ID NO: 298 - protein, 409 aa, Camelina sativa
MYYQNQHQGKNILSSSRMHITTERNPFLRGNSPGESGLILSTDAKPRLKWTPDLHERFIEAVNQLGGADKATPKTIMKVMGIPGLTLYHLKSHLQKYRLSKNLNGQANSGLNKIGMMTMMEEKTPDVDEIQSENLSIGPQPNMNSPISEALQMQIEVQRRLHEQLEVQRHLQLRIEAQGKYLQSVLEKAQETLGRQNLGAAGIEAAKVQLSELVSKVSAEYPNSSFLEPKELQNLCPQQIQTTTYPPDCSLESCLTSSEGTQKTLENNRIGLRTYLGDSTSEQKENMEEEPLFQRMELTWTEGLRGNNNPYLSTMVSETEQRIPYSERSPGRLSIGVGLQGHKGHHHQQGNNEYTEERFKDKSEDHKFETRNHRKGTDSATELDLNTHVESYSTTTRTKQFDLNGFSWN

SEQ ID NO: 299 - protein, 234 aa, Camelina sativa
MRMSCNGCRVLRKGCSDNCSIRPCLQWIKSAESQANATVFLAKFYGRAGLMNLLSTGPDHLRPGIFRSLLYEACGRIVNPIYGSVGLLWSGNWHLCQAAVEAVMRGSPVTPIACDAAVTSQAHPFNNNKLCDIRHVSSKEENVKRRSRGACKGERNVRSQSHESSLSHESPVSSEGTTTEEPKSWIGLELTLGLEPLARGSHVVVPMKKRKLERCGTSEDEDTCKIELGLVCSE

SEQ ID NO: 300 - protein, 157 aa, Camelina sativa
MEGEQEESTMRKRRHPSQEEVARNVATRKPYRGIRRRKWGKWVAEIREPNKRSRLWLGSYTTDVAAARAYDVAVFYLRGPSARLNFPDLLLQEEDHRSAAAAADMPAALIREKAAEVGARVDALLTSASKSPPPPTAKSSLSVIKPDLNQIPESGDI

SEQ ID NO: 301 - protein, 329 aa, Camelina sativa
MTLEALSSNGLLNFLLSETLSPTPFKSLVDLEPLPGNDVIISKNTIMEDISRQESPPPPRQPPATNRGKKRRRRKPRVCKNEEEAENQRMTHIAVERNRRRLMNQHLSVLRSLMPQPFAHKGDQASIVGGAIDFIKELEHKLLSLEAQKLHNAKLNQSVTTSTSQDSNSEPENPHQQSPLSISQFFLHSYDPSQENRNGSTSSVKTALEDLEVTLIETHANIRILSRRRGFRWSTMATSRPPQLSRLVAALQSLSLSVLHLSVTTMDTYAIYSISAKVEESCQLSSVDDIAGAVHHMLSIIEEEPICCSSMSELPFDFSLNHTNATHSL

SEQ ID NO: 302 - protein, 555 aa, Camelina sativa
MKNNNNKSSSSSSYDSSLSPSSSSSSHQNWLSFSLSNNNNNNFNSSSNPNLTSSTSDHQHPHPSHLSLFQAFSTSPVERQDGSPGVSTGDATAVLSIYPGGPKLENFLGGGATTTTTRPMQQMQSLGGVVFSSDLQPPLHPPSAAEIYDSELKSIAASFLGKYSGGHSSEVSSVHKQQQNPLVVPETSPTPKKSVESFGQRTSIYRGVTRHRWTGRYEAHLWDNSCRREGQSRKGRQGGYDKEEKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPKPSQPTATTTADKTVDLTPSEPPSLTTPSLTFDVATPVHDHGGTFYNTGIPIKPDPADHYWSNVFGFQQANTKAEMRPLATFGSDLHNPCPGYAIMPIMQEGENNFGGGYVGSEGYNNHSVASNPVSAIPLSSTTTTMGNGNEGYWINNNISSSYQNAKSNLSVLQTPVFGLE

SEQ ID NO: 303 - protein, 299 aa, Camelina sativa
AKASFGEQEWYFFSPRDRKYPNGARPNRAATSGYWKATGTDKPVLASDGNQKVGVKKALVFYSGKPPKGVKSDWIMHEYRLIENKLNNRPPVCDFGNKKNSLRLDDWVLCRIYKKNNAGRHVDNDKDHDMIDYIFRKIPPSLSAATGLHHHHHNVSRSMNFFPGKFSGGGYGIYSDGNTSLYDGGGMINNNMDTESVDHRDNNNVDVVGLNHASSSVPMMMMANQKRAFPVPYWPVAEEEQDASPSKRFHGGGGDCSNMSSSMMEETPPMMQQQGGGVLGDGLFRTTPYQLPGLNWYPS

SEQ ID NO: 304 - protein, 330 aa, Camelina sativa
MEAFGGFHKEDDEQIDLPPGFRFHPTDEELITHYLHNKVLDMAFSAKAIGEVDLNKAEPWELPYKAKMGEKEWYFFCVRDRKYPTGLRTNRATQAGYWKATGKDKEIYRGKSLVGMKKTLVFYRGRAPKGLKTNWVMHEYRLDGKLSAHNLPKTAKNEWVICRVFHKTAGGKKIPISTLIRIGSYGTGSSLPPLTDTSTYNDKTKTEPVYVPCFSNQAETRGNTLLNCFSNSSLSSSIQPDFLQMIPLYQPHQSINVSENLQSSNPVLTQEQSVLQAMIENNKRQTISRETGGSNTDHSSVFEFGRKRFDHQEVPSSSTGPLDLEPFWNY

SEQ ID NO: 305 - protein, 594 aa, Camelina sativa
MAPMTNWLTFSLSPMEMLRSSDQSQFVSYDASSAASSSPYLLDNFYGWTNQKPQEFFKEEAHLAAAASMADSTILTTFVDPQSHHSQSHIPKLEDFLGDSSSMVRYSDNSQTETQDSSLTQIYDPRHHHQNHHNQTGFYSDHHDFKTMAGFQTAFSTNSGSEVDDSASIGRTHLAGEYLGHVVESSSGPDLGFHGGSTNTGGALSLAVNVNNNSTNQHRNDNEITNHHYRGERNNNNEHNNENKTESEKEKPIVAVETSDCSNKKIADTFGQRTSIYRGVTRHRWTGRYEAHLWDNSCRREGQARKGRQGGYDKEDKAARAYDLAALKYWNATATTNFPITNYSKELEDMKHMTKQEFIASLRRKSSGFSRGASIYRGVTRHHQQGRWQARIGRVAGNKDLYLGTFATEEEAAEAYDIAAIKFRGINAVTNFEMNRYDVEAIMKSALPIGGAAKRLKLSLEAASSEQKPILGHQLHHFQQQQQQQQQQLQLQSSPNHSSINFALCPNSAVQSQQIIPCGIPFEAAALYHHQQQQQQQQQQQQQQQQQQNFFQHFPANAASDSTGSNNNSNVQGSMGLMAPNPAEFFLWPNNQSY

SEQ ID NO: 306 - protein, 205 aa, Camelina sativa
MRKKVSSSTGEEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDPKTKQSNGDIVYQINLQNPTETSEATKITNIDDGNNNILGDVIQEDRQGSNYLSSLWVHEDEFELSTLTNMMDFIDGHCF

SEQ ID NO: 307 - protein, 564 aa, Camelina sativa
MNSMNNWLGFSLSPHDQNHHRTDLDSSPTTTAVDVAGEYCFDLAAAASDGSSAVQTSFPSPFGVVLEAFTRDNNSHSREQRPRLTHLENFLGRTSTIYNTNENVGDGSGGCGGDGGGGGSLGLSMIKTWLSNQPVANVNHQDNGNGARGLSLSMNSSTTCDSNNYINNNDVVQEKTIVDVVEATPKKTIESFGQRTPIYRGVTRHRWTGRYEAHLWDNSCKREGQTRKGRQGGYDKEEKAARAYDLAALKYWGTTTTTNFPMSSYEKEVEEMKHMTRQEYVASLRRKSSGFSRGASIYRGVTRHHQHGRWQARIGRVAGNKDLYLGTFGTQEEAAEAYDIAAIKFRGLSAVTNFDMSRYNVKAILESPSLPIGSSAKRLKDVNSPIPSMMISNNNVSESASNVSGWQNAAFQHHQGMDLSVLQQQQERYVGYYNGGNLSSESTRVCSKQEEEQQRFLSNSIDHHSSTSDDSVTVCGNVVGYGGYQGFAIPVGTSVNCDAFTAAEIAYNARNHYYYAQQQQQQQMQQIPEGDFPVAISNNVGSNMFFHGDGGGEGASMFTVWNGT

SEQ ID NO: 308 - protein, 263 aa, Camelina sativa
MDQEGASQSPSTSTEPVRSRWSPKPEQILILESIFNSGIVNPPKDETVRIRKMLEKFGAVGDANVFYWFQNRRSRSRRRQRQLQAATAAPATSGGAEDHQHMTAMTMHQYPYSNSEIDLGFGSCSNSSSANYFLNGTSSSQVSSFLLGLSSSSGGCESNGMEDLFTMYGHQSDHHHQHSSNAHSMFSPSDGNSNFQYQQGLMTVFINGVPTEVTKGTIDMKATFGEDSVLLHSSGLPLPTDEFGFLMHSLQHGQAYFLVPRQT

SEQ ID NO: 309 - protein, 289 aa, Camelina sativa
MMNRVFGEMIDDAEKPGFFKILRRGDLSSEIMRGIPLNFIKSISEEDLSANIVLKVSWGSSWTIRISRNLCFYFMEKKGWDQFLSDNDLGDNEFLTFTHKGHRCFSVDIYQIDGMELLRPRKSAPTVASSSGLNKTEQRENMFEHSSSESSYLGLKTAESTGRRQTEKSKKKKKMKVESISDGSEDDTLIVPEFTITIKKSYLIFLGIPKMFEQLHMPKETTMFKIHDPERETSWDVMYKFINNKQSRFCAGWIRLAKDLGLTIGDVCTFTLVKPTEMVVTVTRREINL

SEQ ID NO: 310 - protein, 328 aa, Camelina sativa
MTLEALSSNGLLNFLLSETLSPTPFKSLVDLEPLPGNDVIISKNTIMDEISHQEPPPPRPPPATNRGKKRRRRKPRVCKNEEEAENQRMTHIAVERNRRRQMNQHLSVLRSLMPQPFAHKGDQASIVGGAIDFIKELEHKLLSLEAQKLHNAKLNQSVTTSTSQDSNGEPENPHQQSPLSISQFFLHSYDPSQESRNGSTSSVKTALEDLEVTLIETHANIRILSRRRGFRWSTMATARPPQLSRLVAALQSLSLSVLHLSVTTMDTYAIYSISAKVEESCQLSSVDDIAGAVHHMLSIIEEEPICCSSMSELPFDFSLNHTNATHSL

SEQ ID NO: 311 - protein, 233 aa, Arabidopsis thaliana
MRISCNGCRVLRKGCNQDCTIRPCLQWIKSADSQANATLFLAKFYGRAGLLNLIESGPDHLRPAIFRSLLYEACGRIVNPVDGSVGLMWSGNWAQCQAAVDAVLNGLPITHTPLPSASASHQIIPPHRTYDIRHVAKDPTTGGDSSENLATRVNANKSKTQTGRFKRESVNQLGECSHDMWQLPSSSATHGYGHFTLENVESRREAPFNQSSPNLGFDDQVDINEVGLELRLG

SEQ ID NO: 312 - protein, 245 aa, Arabidopsis thaliana
MLKSASPMAFYDIGEQQYSTFGYILSKPGNAGAYEIDPSIPNIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRARGGGNGDGVTMRMDDEGYDTSRSPVRSGKDDLDSNEEKVLLKCWSRMSIVDDHYEPSDLDLDLSHFDWISELVD

SEQ ID NO: 313 - protein, 210 aa, Arabidopsis thaliana
MDNLNVFANEDNQVNGLKRPPPSRVCPRCDSDNTKFCFYNNYSESQPRYFCKNCRRYWTHGGALRNIPVGGSCRKPKRLKVDQSSISEMVSVENQPINHQSFRQTQENNEFVRSFDASSSATVTAVPNHFGYLSELHGVTNLLPIQSFRTMDCLDFGDESFQQGYYDVGSNDLIDNPLINQSIGGYVDNLTSYCINQVEPKLQPRYEHES

SEQ ID NO: 314 - protein, 613 aa, Arabidopsis thaliana
MASAQSFYNQSSVLKINVMVVDDDHVFLDIMSRMLQHSKYRVIAVDDPKKALSTLKIQRDNIDLIITDYYMPGMNGLQLKKQITQEFGNLPVLVMSSDTNKEEESLSCGAMGFIPKPIHPTDLTKIYQFALSNKRNGKSTLSTEQNHKDADVSVPQQITLVPEQADVLKTKRKNCSFKSDSRTVNSTNGSCVSTDGSRKNRKRKPNGGPSDDGESMSQPAKKKKIQWTDSLHDLFLQAIRHIGLDKAVPKKILAFMSVPYLTRENVASHLQKYRIFLRRVAEQGLYSMLSDRGIDSMFRQTHIKEPYFNYYTPSTSWYDTRLNNRSFYSKPVHGFGQSKLLSTTREPVCFNQMPYNYMNRSSTYEPHRIGSGSNLTLPIQSNLSFPNQPSQNEERRSFFEPPVMANKIAQTSQVLGFGQLGPSAISGHNFNNNMTSRYGSLIPSQPGPSHFSYGMQSFLNNENVTYNPQPPANATTQPNLDELPQLENLNLYNDFGNTSELPYNISNFQFDDNKHQQGEADPTKFELPAAKFSTELNHEDDGDWTFVNINQGQSNGETSNTIASPETNTPILNINHNQNQGQDVPEFNDWSFLDPQELVDDDFMNSLFNNDMN

SEQ ID NO: 315 - protein, 378 aa, Zea mays
MMMMGEGVSVPPWSHHVPVSGVDAGVGGDEMTPYLLAALRQYLPCNDAGAAEADDEEAAAMAAGVDGYGCDEFRMYEFKVRRCARARSHDWTECPFAHPGEKARRRDPRRYHYSGAACPDFRKGGCRRGDACDFAHGVFECWLHPARYRTQPCKDGTACRRRVCFFAHTPDQLRVLPPTPQQSSASPRGAGALPESYDGSPLRRQAFETYLTKSIVSSSPTSTLLSPPKTPPSESPPLSPDGAAAAFRRGSWPGAGSPVNDVLASLRQLRLGTASSSPSGGWGGYPASAAAYGSPTAGGLYSLPSTPTALATASGYMPNLEPLDVSFGGDEEPVERVESGRALRAKVFERLSREGAVSCYPAAGTGGPDVGWVSDLIN

SEQ ID NO: 316 - protein, 324 aa, Zea mays
MDMISGSTAATSTPHNNQQAVMLSSPIIKEEARDPKQTRAMPQIGGSGERKPRPQLPEALKCPRCDSNNTKFCYYNNYSMSQPRYFCKACRRYWTHGGTLRNVPIGGGCRKNKHASRFVLGSHTSSSSSATYAPLSPSTNASSSNMSINKHMMMVPNMTMPTPTTMGLFPNVLPTLMPTGGGGGFDFTMDNQHRSLSFTPMSLPSQGPVPMLAAGGSEATPSFLEMLRGGIFHGSSSYNTSLTMSGGNNGMDKPFSLPSYGAMCTNGLSGSTTNDARQLVGPQQDNKAIMKSSNNNNGVSLLNLYWNKHNNNNNNNNNNNNKGQ

SEQ ID NO: 317 - protein, 312 aa, Zea mays
MREEEEASWFARGEEQQLLRPDELMPLTQTLITPHLAVAFDITTHGAGGTGAAGGAGAGPGAGGPDINGGGASSAAGSSGGGGGGGGDEPARTLKRPRLVWTPQLHKRFVDAVAHLGIKNAVPKTIMQLMSVDGLTRENVASHLQKYRLYLKRMQGLGGGGGGGGGGGAGGSHSSGSGTDAATEHLFATGPVPFLPPGHRAPAAADSYPPFSPMGGAHHHQHHQIGHFHHPATRPLAHYGGAAVGGFDHGFLSRVGPPAGPPGMHHRMVGGGAGMGMMAPASFADEMDLGSRGGGGSGSRRELTLFPTSGDH

SEQ ID NO: 318 - protein, 288 aa, Glycine max
MRMSCNGCRVLRKGCSEDCSIRPCLQWIKNPESQANATVFLAKFYGRAGLMNLINAGPENLRPAIFRSLLYEACGRIVNPIYGSVGLLWSGSWQLCQAAVEAVLKGEPITPITSEAAANGRAPPLKAYDIRHVSKDQNSANETPKTKTRSRFKRTSGTLIKPKASKGTGFVPVEPEMANRTASHESGLSHLSEATAMVEGESKESESVVSMDTSNLIHEEPEWVAKTSDGTGESGNEIGLELTLGFEPVSRLHHVVPMKKRKIIELKSCGDSAEKDSCKMELGLEYPA

SEQ ID NO: 319 - protein, 680 aa, Glycine max
MCSDSKSKLSSPTLVVMENSNIQKQNLDGLYNSVLLELSASDDYEAFKREVEEKGLDVNEAGFWYGRRIGSKKMGSETRTPLMIASLFGSAKVLNYILLQKGGGVDVNRVCGSDRATALHCAVAGGSESSLEIVKLLLDAGADAECLDASGNKPVNLIAPAFDSLSKSRRKALEMFLRGGGERDELMSQEMELQMFSVPEKKEGSDNKKEYPVDISLPDINNGVYGTDEFRMYNFKVKPCSRAYSHDWTECPFVHPGENARRRDPRKYPYSCVPCPEFRKGTCQKGDSCEYAHGVFESWLHPAQYRTRLCKDETGCARKVCFFAHKPEELRPVYASTGSAMPSPKSYSASGLDMTAMSPLALSSTSLPMPTVSTPPMSPLAAASSPKSGSMWQNKINLTPPSLQLPGSRLKAALSARDLEMEMELLGLESPARQQQQQQQQLIEEIARISSPSFRSKEFNRIVDLNPTNLDDLLASADPSVFSQLHGLSVQPSTPTQSGLQMRQNMNHLRASYPSNIPSSPVRKPSAFGFDSSAAVATAVMNSRSAAFAKRSQSFIDRGAATHHLGLSSASNSSCRVSSTLSDWSSPTGKLDWGVNGDKLNKLRKSTSFGFRNSGVTASPIAQPEFGAEPDVSWVHSLVKDVPSERSEIFGAEKQQYDLSKEMLPPWMEQLYIEQEQMVA

SEQ ID NO: 320 - protein, 317 aa, Glycine max
MEQRVGEGGGMNKQPRDSRVKEIQQGDAQVHAQAPQQPQKCPRCDSLNTKFCYYNNYSLSQPRYFCKTCRRYWTQGGTLRNVPVGGGCRKGKRAKTSNSSSSSENINSSFRSLPLQQPQGMVVQTQAPPLTSVVKAKDPSSVVASPFYQSGGYLSSLAAMHSLNPSSSHPFDQSLNVIAGSDALRSSNLGLLSGFNVQRPIGQICPPYLYHQMGSDEREMVSLYEQGLVNPSSSSMANTNTNTNGSGVSQHDWPQSFINNNVSNRASDASLWSTISTTIGGNSERTSTSGVGVDVGAGSSSFVTNQWPNLPGYGPPP

SEQ ID NO: 321 - protein, 667 aa, Glycine max
MTHERVDIISVLVVDDDKTSLAIVSNILTSLGYKVLTANSALNALEILREFRGFIDLLITELHISGMNGFEFQKYVENQFHLPVIIMSSDGRNSVISKSLANGAAHYILKPFSADDFKDIWQYARKLTFQNIEGGSIPGDNTSIQDVHSAISSNVSKRKRKCFPRKSTQMNKEGQSGESSTLVKKPKVVWTPYLHNRFLLAIKQIGLEKAVPKTILQVMNVPNLTRENVASHLQKYRIFLRKVADKGLLEGLSNRDLRSRFAYGLSASMIKDIQAKTAKSRVTAQQYMKRIAHQSVYGGIANAVKSYNHVSSVTNTPLGRSHQFPHPYHKGLNMMLHNQHGSSSDQARLRAQSSFGSNVGTNNIQQNTLGSYANQPYYAQSSYNNVGVVFPSDGVTRHGLMTSTNGLRGGVNYGGNQLMYPNYASLGNQHKFSCGQGNWNIGSLNYNRSFGLINETSENVNKNVLSFGQGNFDLAQGGFASTSSAGECWSKELPAENIQGNPTLHQQLQGNFAENDIGTSIGEGNVNLLDEDDFSNLFMMLDEMDLLNETEENHNANDFLKSDFSSSNHAVQSLEQSYKALTNYQATTDVIINPTKGTSNLPNETSTSSDKNSNRLMGGDDGYANMEHLNRFMMNDDVSSGSNSATDQDWDFELIEALFGDEKNQGE

SEQ ID NO: 322 - protein, 237 aa, Brassica napus
MRISCNGCRVLRKGCNQDCTIRPCLQWIKSADSQANATLFLAKFYGRAGLLNLIESGPNHLRPAIFRSLLYEACGRIVNPVDGSVGLMWSGNWSQCQAAVDAILNGLPITHTPLASASASHQIIPPHRTYDIRHVAKDPTTGGDSSESLALAPRVNGNKAKTKTGRLKRLAETVDFQLGECSHDTWQLQCSGATHGYGQLALENVENRREAPLNQSSNLGRDDQVDTNEVGLELRLG

SEQ ID NO: 323 - protein, 246 aa, Brassica napus
MLKSVNPMTFYGIGEQQFPTLGYIVSKPGNAGAYEIDPPLPTVNDVIYSSDEFRMYAYKIKRCPRTRSHDWTECPYAHRGEKATRRDPRRYSYCAVACPAFRNGACHRGDTCEFAHGVFEYWLHPARYRARACNAGNMCQRKVCFFAHAPEQLRQSEGKHRCRYAYRPVRTTVARGRNGDGVGIREDGEDFDTWQSPVKSGESELDINEERLLKCWSGMSIVDDHYDPSDLDLNLSHIDWISALVD

SEQ ID NO: 324 - protein, 206 aa, Brassica napus
MDKLNVFVRGDNQVNEEKPPARVCPRCDSDNTKFCYYNNYSLSQPRYSCKNCRRYWTHGGTLRNIPIGGSGRKTKRPKIDQPSAENQQVNNHQPFLHGQETNEFVGTFNGSSSSDVVVGNHFGFHEIHGAMVNNVPPVRSFPPMEALHISDVSSRQDYYDVGSNDLIDNPLINRPTEDDLNMWNESYNNTMNVNHNASTSGRRGYL

SEQ ID NO: 325 - protein, 594 aa, Brassica napus
MTFAQSLNNQSSVLRINIMVVDDDPVSREIVSRMLERSKYRDPSMEITVIAVRDAREALSTLKIQRNNIDLIVTDYYMPGMNGLQLKQQITRQFGNFPVIVMSSDTNKEQESLACGSVCFLPKPIKPTDLPKIYQVAFTYKRKGKSISRTEHNHMDTNVSIPQQIQLLPEQANVSKTKKNKKFSSKSDSRSVNSFNGSCDSTDGSRKNRKRKSNGDFGDDDESLPQPSKKSKLSWSDYLHDLFLQAIHHIGLDKAVPKKILEFMDVSYLTRENVASHLQKYRNFLRKVAENSGMLHGRGMEPYHSNYTTSSSWYDTGLNNKSSYSKPRHGLGQSRLLSNTCEPVRFNQMPYNHMNRNLSFSTQPLQNEGSRSFLEATVTANKTGQTSQVLGFGQHGMSAINGNNFNDNTMSSYARMSSYESLTPTQPGPSNISYGLLLNNENTAYKPQPHASTTIQLDNLSMYDDLGNINEIPCDLSNFDFDHDKQQEEAVSANKFEIPANLETELNQTSSLEEDGDWTFLNISQGHFNEKTSNTFAAPETNDPTFNKNPNHAQEQDVPDFDWSLLDLENLANENDFMDSMFTNDNSMFTNDMN

SEQ ID NO: 326 - protein, 226 aa, Oryza sativa
MRMSCNGCRVLRKGCSEGCTIRPCLQWIKTPEAQANATVFLAKFYGRAGLLNLLAAGPDHLRPAVFRSLLYEACGRIVNPIYGSVGLLWSGQWQACQAAVEAVLKGDPVVQVSSEAAAAAQATPPLRAYDIRHVSKDAEADAAANLLRVARGGRTRFKRASSSSNSKHGAKLAGAAAAKRAASPSSSSPTHETEPEAVVVVGDHDDDYHHPALSPRGPRGIRAGQP

SEQ ID NO: 327 - protein, 402 aa, Oryza sativa
MMMMGEGAHAPPWQQHVASPVSGVEGGGGRESEVVAAPYHLLDTLRHYLPSNEAAAAEDEEEAAAVAAAVDAYACDEFRMYEFKVRRCARGRSHDWTECPFAHPGEKARRRDPRRYCYSGTACPDFRKGGCKRGDACEFAHGVFECWLHPARYRTQPCKDGTACRRRVCFFAHTPDQLRVLPPSQQQGSNSPRGCGGGGAGAAASPLAESYDGSPLRRQAFESYLTKSIMSSSPTSTLVSPPRSPPSESPPLSPDAAGALRRGAWAGVGSPVNDVHVSLRQLRLGSPRSAPSCASFLPAGYQYGSPKSPAAAAAAALYSLPSTPTRLSPVTVTTASGATVTVEPLDLGLIEEEQPMERVESGRALREKVFERLSKEATVSTDAAAAAAGVAPDVGWVSDLIN

SEQ ID NO: 328 - protein, 373 aa, Oryza sativa
MASGGALSPVEEKPTVVKTTKAEQHEEEAAVAVKSAAEMMKKSSPCCPRCNSIKTKFCYYNNYSMAQPRYFCRECRRYWTQGGSLRNVPVGGGCRKSKRSSASSASASAASPPAPAVGAAPPVVPALSSAISKLLQSEPMAAPCADFPNVLPTFVSTGFELPAAAGDRLSLGSFGAFGNLSAAVAAPGGGGGSSTTTSFMDMLRGVGGLFDGVGNSHQMGGNGGGGGSYYAPLITGAGNGMLMPPPPLPPFSGSLMQHGMQGLFANHAMGGGGGGVMNAGEDGSVMAGLGGGQWPPALGGADEQQGGGDGGEAVMTKDTGGGASSSASRPDYFYGWNSAAGGVVAGGGIGGNAAAATGATPWQGLIDSSSAMM

SEQ ID NO: 329 - protein, 691 aa, Oryza sativa
MAPVEDGGGVEFPVGMKVLVVDDDPTCLAVLKRMLLECRYDATTCSQATRALTMLRENRRGFDVIISDVHMPDMDGFRLLELVGLEMDLPVIMMSADSRTDIVMKGIKHGACDYLIKPVRMEELKNIWQHVIRKKFNENKEHEHSGSLDDTDRTRPTNNDNEYASSANDGAEGSWKSQKKKRDKDDDDGELESGDPSSTSKKPRVVWSVELHQQFVNAVNHLGIDKAVPKKILELMNVPGLTRENVASHLQKFRLYLKRIAQHHAGIANPFCPPASSGKVGSLGGLDFQALAASGQIPPQALAALQDELLGRPTNSLVLPGRDQSSLRLAAVKGNKPHGEREIAFGQPIYKCQNNAYGAFPQSSPAVGGMPSFSAWPNNKLGMADSTGTLGGMSNSQNSNIVLHELQQQPDAMLSGTLHSLDVKPSGIVMPSQSLNTFSASEGLSPNQNTLMIPAQSSGFLAAMPPSMKHEPVLATSQPSSSLLGGIDLVNQASTSQPLISAHGGGNLSGLVNRNPNVVPSQGISTFHTPNNPYLVSPNSMGMGSKQPPGVLKTENSDALNHSYGYLGGSNPPMDSGLLSSQSKNTQFGLLGQDDITGSWSPLPNVDSYGNTVGLSHPGSSSSSFQSSNVALGKLPDQGRGKNHGFVGKGTCIPSRFAVDEIESPTNNLSHSIGSSGDIMSPDIFGFSGQM

What is claimed is:

1. A modified plant comprising a polynucleotide comprising a promoter operably linked to a coding sequence, wherein:
    (a) the coding sequence encodes a transcription factor that is an ortholog of zinc finger CCCH domain-containing protein 54-like protein of *Arabidopsis thaliana* and has at least 99% sequence identity to SEQ ID NO: 204;
    (b) the promoter is non-cognate with respect to the coding sequence; and
    (c) the modified plant is *Camelina sativa*.

2. The modified plant according to claim 1, wherein the modified plant comprises the polynucleotide based on introduction of the polynucleotide by a transformation procedure.

3. The modified plant according to claim 2, wherein the non-cognate promoter comprises a constitutive promoter.

4. The modified plant according to claim 2, wherein the non-cognate promoter comprises a seed-specific promoter.

5. The modified plant according to claim 1, wherein the coding sequence occurs naturally at a location in the genome of the modified plant, and the modified plant comprises the polynucleotide based on editing of an endogenous promoter that is operably linked to the coding sequence at the location in the genome to make the non-cognate promoter operably linked to the coding sequence at the location in the genome.

6. The modified plant according to claim 5, wherein the editing increases strength of the non-cognate promoter in comparison to the endogenous promoter.

7. The modified plant according to claim 5, wherein the editing increases tissue specificity of the non-cognate promoter in comparison to the endogenous promoter.

8. The modified plant according to claim 1, wherein the modified plant has one or more of the following traits:
    (i) a seed yield that is at least 5% higher in comparison to a reference plant not comprising the polynucleotide; or
    (ii) a seed oil content that is at least 5% higher in comparison to a reference plant not comprising the polynucleotide.

9. A method for producing a modified plant having increased seed yield and/or oil content in comparison to a reference plant by transformation, the method comprising:
    (1) transforming one or more host plants or plant cells with a genetic construct comprising a polynucleotide comprising a promoter operably linked to a coding sequence, wherein:
        (a) the coding sequence encodes a transcription factor that is an ortholog of zinc finger CCCH domain-containing protein 54-like protein of *Arabidopsis thaliana* and has at least 99% sequence identity to SEQ ID NO: 204;
        (b) the promoter is non-cognate with respect to the coding sequence; and
        (c) the modified plant is *Camelina sativa*; and
    (2) selecting a transformed plant or plant cell in which the polynucleotide is stably maintained, thereby obtaining the modified plant, wherein the reference plant does not comprise the polynucleotide.

10. The method according to claim 9, wherein the non-cognate promoter comprises a constitutive promoter.

11. The method according to claim 9, wherein the non-cognate promoter comprises a seed-specific promoter.

12. A method for producing a modified plant having increased seed yield and/or oil content in comparison to a reference plant by editing, the method comprising:
    (1) editing the genome of one or more host plants or plant cells to comprise a polynucleotide comprising a promoter operably linked to a coding sequence, wherein:
        (a) the coding sequence encodes a transcription factor that is an ortholog of zinc finger CCCH domain-containing protein 54-like protein of *Arabidopsis thaliana* and has at least 99% sequence identity to SEQ ID NO: 204;
        (b) the promoter is non-cognate with respect to the coding sequence;
        (c) the coding sequence occurs naturally at a location in the genome;
        (d) the editing is of an endogenous promoter that is operably linked to the coding sequence at the location in the genome to make the non-cognate promoter operably linked to the coding sequence at the location in the genome; and
        (e) the modified plant is *Camelina sativa*; and
    (2) selecting an edited plant or plant cell in which the polynucleotide is stably maintained, thereby obtaining the modified plant, wherein the reference plant does not comprise the polynucleotide.

13. The method according to claim 12, wherein the editing increases strength of the non-cognate promoter in comparison to the endogenous promoter.

14. The method according to claim 12, wherein the editing increases tissue specificity of the non-cognate promoter in comparison to the endogenous promoter.

15. The modified plant according to claim 1, wherein the transcription factor comprises SEQ ID NO: 204.

* * * * *